US010266582B2

(12) United States Patent
Gonzaga-Jauregui

(10) Patent No.: US 10,266,582 B2
(45) Date of Patent: Apr. 23, 2019

(54) GPR156 VARIANTS AND USES THEREOF

(71) Applicant: Regeneron Pharmaceuticals, Inc., Tarrytown, NY (US)

(72) Inventor: Claudia Gonzaga-Jauregui, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

(21) Appl. No.: 15/662,689

(22) Filed: Jul. 28, 2017

(65) Prior Publication Data

US 2018/0030114 A1 Feb. 1, 2018

Related U.S. Application Data

(60) Provisional application No. 62/367,973, filed on Jul. 28, 2016.

(51) Int. Cl.
*C07K 14/705* (2006.01)
*C12Q 1/6883* (2018.01)
*C12Q 1/68* (2018.01)

(52) U.S. Cl.
CPC ...... *C07K 14/70571* (2013.01); *C07K 14/705* (2013.01); *C12Q 1/6883* (2013.01); *C12Q 2600/156* (2013.01)

(58) Field of Classification Search
None
See application file for complete search history.

(56) References Cited

PUBLICATIONS

Lund et al., Nucleotide Serquence Analysis of a cDNA Encoding Human Ubiqtitin Reveals . . . , (Jun. 25, 1985), The Journal of Biological Chemistry 260(12):7609-7613.*

Database, UniProt, "SubName: Full=G protein-coupled receptor 156 {ECO: 0000313, Ensembl: ENSCPOP00000019815}", 2012, XP002774351, 2 pages.

Catapano et al., "G Protein-coupled Receptors in Major Psychiatric Disorders", 2007, Biochimica et Biophysica Acta, 1768(4), pp. 976-993.

Database, Geneseq, "UDP glycosyltransferase 1 (UGT1A1) Allele-specific Oligonucleotide #59", 2002, XP002774352, 1 page.

Database, EMBL, "JP 2015518712-A/41866: Compositions and Methods for Modulating MECP2 Expression", 2015, XP002774353, 1 page.

Database, Geneseq, "Human TNFRSF11B gene ASO probe, SEQ ID No. 11", 2001, XP002774354, 1 page.

Bochdanovits, Z., et al., "Genome-wide Prediction of Functinal Gene-gene Interactions Inferred from Patterns of Genetic Differentiation in Mice and Men", 2008, PLOS One, 3(2), pp. e1593, 8 pages.

International Search Report and Written Opinion for PCT Application PCT/US2017/044321.

Calver A., et al., "Molecular Cloning and Characterisation of a Novel GABAb-related G-protein Coupled Receptor", Brain Res Mol Brian Res, 2003, 110, p. 305-317.

Vassilatis, D., et al., "The G Protein-coupled Receptor Repertoires of Human and Mouse," Proc Natl Acad Sci USA, 2003, 100, p. 4903-4908.

* cited by examiner

*Primary Examiner* — John D Ulm
(74) *Attorney, Agent, or Firm* — Stradley Ronon Stevens & Young, LLP

(57) ABSTRACT

The disclosure provides nucleic acids, including cDNA, comprising alterations that encode aspartic acid at a position corresponding to position 533 of the human G protein-coupled receptor 156 protein (GPR156). The disclosure also provides isolated and recombinant human GPR156 protein variants that comprise an aspartic acid at a position corresponding to position 533. The change to aspartic acid, and the gene encoding this change, associate with unipolar depression. The disclosure also provides methods for determining whether a subject has or has a risk of developing unipolar depression, based on the identification of such alterations in the gene (DNA or RNA) encoding GPR156.

36 Claims, 2 Drawing Sheets

Specification includes a Sequence Listing.

GPR156 VARIANTS AND USES THEREOF

CROSS REFERENCE TO RELATED APPLICATIONS

This application claims priority to U.S. Provisional Application No. 62/367,973, filed on Jul. 28, 2016, the contents of which are incorporated by reference herein, in their entirety and for all purposes.

REFERENCE TO A SEQUENCE LISTING

This application includes a Sequence Listing submitted electronically as a text file named 18923800701SEQ, created on Jul. 28, 2017, with a size of 986 kilobytes. The Sequence Listing is incorporated by reference herein.

FIELD

The disclosure relates generally to the field of genetics. More particularly, the disclosure relates to gene alterations and polypeptide variants in the G protein-coupled receptor 156 that associate with, for example, unipolar depression and anxiety disorders.

BACKGROUND

Various references, including patents, patent applications, accession numbers, technical articles, and scholarly articles are cited throughout the specification. Each reference is incorporated by reference herein, in its entirety and for all purposes.

G protein-coupled receptors (GPCRs) are a large superfamily of cell surface receptors that are characterized by 7 helical transmembrane domains, together with N-terminal extracellular and C-terminal intracellular domains (Cherezov V, et al., Science 318: 1258-1265 (2007)). GPCRs are expressed in a variety of cell types, and participate in transducing extracellular signals across the cellular membrane and into the cellular interior (Kobilka R, Biochim. Biophys. Acta 1768: 794-807 (2007)). So important is the role that GPCRs play in biology that in 2012, the Nobel Prize in Chemistry was awarded to two scientists who identified how GPCRs function (Clark R, Proc. Natl. Acad. Sci. USA 110: 5274-5275 (2013)).

GPR156 (G protein-coupled receptor 156), is a human gene which encodes a GPCR belonging to metabotropic glutamate receptor subfamily (Calver A, et al., Brain Res. Mol. Brain Res. 110: 305-307 (2003)). Other names that have been used to reference GPR156 in the literature are GABABL (GABAB-like) and PGR28 (Vassilatis D, Proc. Natl. Acad. Sci. USA 100: 4903-4908 (2003)). In mice, GPR156 is referred to as Gpr156 or Gababl. Identifying new GPR156 variants would be helpful in the continued study of the role of GPR156 in human physiology and its potential role in diseases. The present disclosure provides novel GPR156 variants that will aid in understanding the biology of GPR156, and will facilitate the identification of potentially therapeutic agents that modulate GPR156 and/or its cellular biological pathway.

SUMMARY

The present disclosure provides novel nucleic acid molecules (i.e., genomic DNA, mRNA, and cDNA) encoding GPR156 variant polypeptides, and GPR156 variant polypeptides, that have been demonstrated herein to be associated with a spectrum of mood disorders, such as depression, such as unipolar depression, and anxiety disorders.

The present disclosure provides isolated nucleic acid molecules comprising a nucleic acid sequence encoding a human GPR156 protein, wherein the protein comprises an aspartic acid at the position corresponding to position 533 according to SEQ ID NO:4, or the complement of the nucleic acid sequence.

The present disclosure also provides genomic DNA molecules comprising a nucleic acid sequence encoding at least a portion of the human GPR156 protein, wherein the portion comprises an aspartic acid at the position corresponding to position 533 according to SEQ ID NO:4, or the complement of the nucleic acid sequence.

The present disclosure also provides cDNA molecules comprising a nucleic acid sequence encoding at least a portion of the human GPR156 protein, wherein the portion comprises an aspartic acid at the position corresponding to position 533 according to SEQ ID NO:4, or the complement of the nucleic acid sequence.

The present disclosure also provides mRNA molecules comprising a nucleic acid sequence encoding at least a portion of the human GPR156 protein, wherein the portion comprises an aspartic acid at the position corresponding to position 533 according to SEQ ID NO:4, or the complement of the nucleic acid sequence.

The present disclosure also provides vectors comprising any of the isolated nucleic acid molecules disclosed herein.

The present disclosure also provides compositions comprising any of the isolated nucleic acid molecules or vectors disclosed herein and a carrier.

The present disclosure also provides host cells comprising any of the isolated nucleic acid molecules or vectors disclosed herein.

The present disclosure also provides isolated or recombinant polypeptides comprising at least a portion of the human GPR156 protein, wherein the portion comprises an aspartic acid at the position corresponding to position 533 according to SEQ ID NO:4.

The present disclosure also provides compositions comprising any of the isolated or recombinant polypeptides disclosed herein and a carrier.

The present disclosure also provides a probe or a primer comprising a nucleic acid sequence comprising at least about 5 nucleotides, which hybridizes to a nucleic acid sequence encoding a human GPR156 protein comprising an aspartic acid at the position corresponding to position at 533 according to SEQ ID NO:4, or which hybridizes to the complement of the nucleic acid sequence encoding the human GPR156 protein comprising the aspartic acid at the position corresponding to position at 533 according to SEQ ID NO:4.

The present disclosure also provides supports comprising a substrate to which any of the probes disclosed herein hybridize.

The present disclosure also provides an allele-specific probe or primer comprising a nucleic acid sequence which is complementary to a nucleic acid sequence encoding a GPR156 protein, wherein the allele-specific probe or primer comprises a nucleic acid sequence which is complementary to the nucleic acid codon encoding an aspartic acid at the position corresponding to position 533 according to SEQ ID NO:4. In some embodiments, the allele-specific probe or primer specifically hybridizes to a nucleic acid sequence encoding a GPR156 protein comprising an aspartic acid at the position corresponding to position 533 according to SEQ ID NO:4, or to the complement thereof. The allele-specific probe or primer does not hybridize to a nucleic acid sequence encoding a GPR156 protein which does not comprise an aspartic acid at the position corresponding to position 533 according to SEQ ID NO:4.

The present disclosure also provides methods for diagnosing unipolar depression or detecting a risk of unipolar depression in a human subject, comprising: detecting an alteration in a nucleic acid molecule encoding a GPR156 protein obtained from the human subject, wherein the alteration encodes an aspartic acid at the position corresponding to position 533 according to SEQ ID NO:4; and diagnosing the human subject with unipolar depression if the subject has one or more symptoms of depression, or diagnosing the human subject as at risk for unipolar depression if the subject does not have one or more symptoms of depression.

The present disclosure also provides methods for diagnosing an anxiety disorder or detecting a risk of an anxiety disorder in a human subject, comprising: detecting an alteration in a nucleic acid molecule encoding a GPR156 protein obtained from the human subject, wherein the alteration encodes an aspartic acid at the position corresponding to position 533 according to SEQ ID NO:4; and diagnosing the human subject with an anxiety disorder if the subject has one or more symptoms of an anxiety disorder, or diagnosing the human subject as at risk for an anxiety disorder if the subject does not have one or more symptoms of an anxiety disorder.

The present disclosure also provides antidepressants for use in the treatment of unipolar depression in a human subject determined to comprise an alteration in a gene encoding the human GPR156 protein, wherein the alteration encodes an aspartic acid at the position corresponding to position 533 according to SEQ ID NO:4.

The present disclosure also provides antidepressants for use in the treatment of an anxiety disorder in a human subject determined to comprise an alteration in a gene encoding the human GPR156 protein, wherein the alteration encodes an aspartic acid at the position corresponding to position 533 according to SEQ ID NO:4.

BRIEF DESCRIPTION OF THE FIGURES

The accompanying figures, which are incorporated in and constitute a part of this specification, illustrate several aspects and together with the description serve to explain the principles of the present disclosure.

Figure 1:
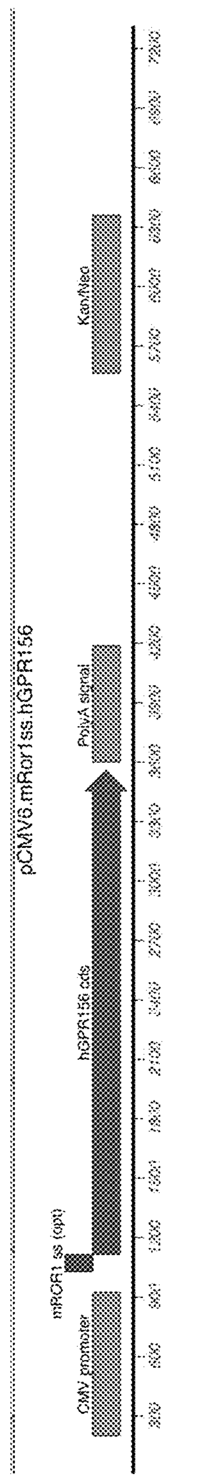
FIG. 1 shows a vector map of mRor1ss.hGPR156 expression vector.

Additional advantages of the present disclosure will be set forth in part in the description which follows, and in part will be apparent from the description, or can be learned by practice of the embodiments disclosed herein. The advantages of the present disclosure will be realized and attained by means of the elements and combinations particularly pointed out in the appended claims. It is to be understood that both the foregoing general description and the following detailed description are exemplary and explanatory only and are not restrictive of the embodiments, as claimed.

DESCRIPTION

Various terms relating to aspects of disclosure are used throughout the specification and claims. Such terms are to be given their ordinary meaning in the art, unless otherwise indicated. Other specifically defined terms are to be construed in a manner consistent with the definition provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-express basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the terms "subject" and "patient" are used interchangeably. A subject may include any animal, including mammals. Mammals include, without limitation, farm animals (e.g., horse, cow, pig), companion animals (e.g., dog, cat), laboratory animals (e.g., mouse, rat, rabbits), and non-human primates. In some embodiments, the subject is a human being.

As used herein, a "nucleic acid," a "nucleic acid molecule," a "nucleic acid sequence," "polynucleotide," or "oligonucleotide" can comprise a polymeric form of nucleotides of any length, may comprise DNA and/or RNA, and can be single-stranded, double-stranded, or multiple stranded. One strand of a nucleic acid also refers to its complement.

As used herein, the phrase "corresponding to" or grammatical variations thereof when used in the context of the numbering of a given amino acid or nucleic acid sequence or position refers to the numbering of a specified reference sequence when the given amino acid or nucleic acid sequence is compared to the reference sequence (e.g., with the reference sequence herein being the nucleic acid molecule or polypeptide of (wild type or full length) GPR156). In other words, the residue (e.g., amino acid or nucleotide) number or residue (e.g., amino acid or nucleotide) position of a given polymer is designated with respect to the reference sequence rather than by the actual numerical position of the residue within the given amino acid or nucleic acid sequence. For example, a given amino acid sequence can be aligned to a reference sequence by introducing gaps to optimize residue matches between the two sequences. In these cases, although the gaps are present, the numbering of the residue in the given amino acid or nucleic acid sequence is made with respect to the reference sequence to which it has been aligned.

For example, the phrase "GPR156 protein, wherein the protein comprises an aspartic acid at the position corresponding to position 533 according to SEQ ID NO:4" means that, if the amino acid sequence of the GPR156 protein is aligned to the sequence of SEQ ID NO:4, the GPR156 protein has an aspartic acid at the position that corresponds to position 533 of SEQ ID NO:4. The same applies for the phrases "GPR156 protein, wherein the protein comprises an aspartic acid at the position corresponding to position 533 referring to SEQ ID NO:4" and "GPR156 protein, wherein the protein comprises an aspartic acid at the position corresponding to position 533 of SEQ ID NO:4." Or, in other words, these phrases (e.g. the phrase "GPR156 protein, wherein the protein comprises an aspartic acid at the position corresponding to position 533 according to SEQ ID NO:4") refer to a GPR156 protein, which has an aspartic acid that is homologous to the aspartic acid at position 533 of SEQ ID NO:4. Herein such a protein is also referred to as "GPR156 protein with the E533D mutation" or "GPR156 protein with the E533D variation." In line with this, the corresponding E533D variation is also referred to as "E533D mutation (within the GPR156 protein)" or "E533D variation (within the GPR156 protein)."

As described above, a position within a GPR156 protein that corresponds to position 533 of SEQ ID NO:4 can easily be identified by performing a sequence alignment between the given GPR156 protein and the amino acid sequence of SEQ ID NO:4. A variety of computational algorithms exist that can be used for performing a sequence alignment in order to identify an amino acid position that corresponds to position 533 in SEQ ID NO:4. For example, by using the NCBI BLAST algorithm (Altschul et al. 1997 Nucleic Acids Res. 25: 3389-3402) or CLUSTALW software (Sievers and Higgins 2014 Methods Mol. Biol. 1079: 105-116.) sequence alignments may be performed. However, sequences can also be aligned manually.

It has been observed in accordance with the disclosure that certain variations in GPR156 associate with a risk of developing mood disorders, such as unipolar depression and an anxiety disorder. In general, the function of this protein is poorly understood, with little published information about its biochemistry or its associated phenotypes. It is believed that no variants of the GPR156 gene or protein have any known association with any mood or neurologic disorders in adult human beings. It is further believed that no variants of the GPR156 gene or protein have any known association with depression generally or unipolar depression or an anxiety disorder specifically in adult human beings. A rare variant in the GPR156 gene segregating with the phenotype of unipolar depression in affected family members has been identified in accordance with the disclosure. For example, a genetic alteration that changes the amino acid of position 533 in the human GPR156 protein (e.g., wild type SEQ ID NO:1) to aspartic acid has been observed to indicate that the human having such an alteration may develop unipolar depression. Altogether, the genetic analyses described herein surprisingly indicate that the GPR156 gene and, in particular, variants in the GPR156 associate with increased susceptibility to unipolar depression and an anxiety disorder. Therefore, human subjects having GPR 156 alterations that associate with unipolar depression or an anxiety disorder may be treated such that unipolar depression is inhibited, the symptoms thereof are reduced, and/or development of symptoms is repressed. Accordingly, the present disclosure provides isolated or recombinant GPR156 variant genes, including cDNA and mRNA, as well as isolated or recombinant GPR156 variant polypeptides. Additionally, the disclosure provides methods for leveraging the identification of such variants in subjects to identify or stratify risk in such subjects of developing unipolar depression or an anxiety disorder, or to diagnose subjects as having unipolar depression or an anxiety disorder, such that subjects at risk or subjects with active disease may be treated.

The amino acid sequences for two full length wild type GPR156 proteins are set forth in SEQ ID NO:1. Referring to SEQ ID NO:1, position 516 of the full length wild type GPR156 protein is either a glutamic acid or an aspartic acid. The amino acid sequence of another wild type GPR156 protein is set forth in SEQ ID NO:2 (which contains a deletion of 4 amino acids at positions corresponding to positions 198 to 201 of SEQ ID NO:1). Position 512 of this wild type GPR156 protein (referring to SEQ ID NO:2) is either a glutamic acid or an aspartic acid. In some embodiments, position 512 of this wild type GPR156 protein (referring to SEQ ID NO:2) is a glutamic acid. In some embodiments, position 512 of this wild type GPR156 protein (referring to SEQ ID NO:2) is an aspartic acid. The amino acid sequence of a GPR156 protein comprising positions 310 to 814 of SEQ ID NO:1 is set forth in SEQ ID NO:3. Positions 310 to 814 of SEQ ID NO:1 define the cytoplasmic domain of GPR156. Position 207 of this GPR156 protein (referring to SEQ ID NO:3) is either a glutamic acid or an aspartic acid. In some embodiments, position 207 of this GPR156 protein (referring to SEQ ID NO:3) is a glutamic acid. In some embodiments, position 207 of this GPR156 protein (referring to SEQ ID NO:3) is an aspartic acid.

The present disclosure provides nucleic acid molecules encoding GPR156 variant proteins that associate with unipolar depression or an anxiety disorder. For example, the present disclosure provides isolated nucleic acid molecules comprising a nucleic acid sequence encoding a human GPR156 protein, wherein the protein comprises an aspartic acid at the position corresponding to position 533 (E533D) according to SEQ ID NO:4, or the complement of the nucleic acid sequence. In some embodiments, the position corresponding to position 516 of SEQ ID NO:4 is a glutamic acid. In some embodiments, the position corresponding to position 516 of SEQ ID NO:4 is an aspartic acid.

An isoform of GPR156 exists, wherein four amino acids in the N-terminal to central region of the protein are deleted. The amino acid sequence of this GPR156 isoform is shown in SEQ ID NO:5. In this GPR156 isoform position 529 corresponds to position 533 according to SEQ ID NO:4. In some embodiments, the isolated nucleic acid molecules comprise a nucleic acid sequence encoding a human GPR156 protein, wherein the protein comprises an aspartic acid at the position corresponding to position 529 (E529D) according to SEQ ID NO:5, or the complement of the nucleic acid sequence. In some embodiments, position 512 of SEQ ID NO:5 is a glutamic acid. In some embodiments, the position corresponding to position 512 of SEQ ID NO:5 is an aspartic acid.

In some embodiments, the nucleic acid molecule comprises or consists of a nucleic acid sequence that encodes a human GPR156 protein having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:4, wherein the GPR156 protein comprises an aspartic acid at the position corresponding to position 533 according to SEQ ID NO:4, or the complement of the nucleic acid sequence. In some embodiments, the position corresponding to position 516 of this nucleic acid molecule (referring to SEQ ID NO:4) is a glutamic acid. In some embodiments, the position corresponding to position 516 of this nucleic acid molecule (referring to SEQ ID NO:4) is an aspartic acid. Herein, if reference is made to percent sequence identity, the higher percentages of sequence identity are preferred over the lower ones.

In some embodiments, the nucleic acid molecule comprises or consists of a nucleic acid sequence that encodes a human GPR156 protein having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:5, wherein the GPR156 protein comprises an aspartic acid at the position corresponding to position 529 according to SEQ ID NO:5, or the complement of the nucleic acid sequence. In some embodiments, the position corresponding to position 512 of this GPR156 protein (referring to SEQ ID NO:5) is a glutamic acid. In some embodiments, the position corresponding to position 512 of this GPR156 protein (referring to SEQ ID NO:5) is an aspartic acid.

In some embodiments, the nucleic acid sequence comprises DNA and the aspartic acid at the position corresponding to position 533 is encoded by the codon GAT or GAC. In some embodiments, the nucleic acid sequence comprises RNA and the aspartic acid at the position corresponding to position 533 is encoded by the codon GAU or GAC in the RNA molecule. In some embodiments, the aspartic acid at the position corresponding to position 533 is encoded by the codon GAT. In some embodiments, the GPR156 protein encoded by the nucleic acid sequence comprises the amino acid sequence of SEQ ID NO:4 or SEQ ID NO:5.

The nucleic acid sequences for two wild type GPR156 genomic DNAs (i.e., alternate alleles) are set forth in SEQ ID NO:7 (see, "n" at position 117,166, which can be a, g, t, or c). Positions 117,164 to 117,166 of these wild type GPR156 genomic DNAs (referring to SEQ ID NO:7) encode either a glutamic acid (via the codon GAA or GAG) or an aspartic acid (via the codon GAT or GAC). Positions 117,215 to 117,217 of these wild type GPR156 genomic DNAs (referring to SEQ ID NO:7) encode a glutamic acid (via the codon GAA or GAG).

The nucleic acid sequence of another wild type GPR156 genomic DNA is set forth in SEQ ID NO:8 (which contains a deletion of 12 nucleotides at positions corresponding to positions 98,428 to 98,439 of SEQ ID NO:7). Positions 117,152 to 117,154 of this wild type GPR156 genomic DNA (referring to SEQ ID NO:8) encode either a glutamic acid (via the codon GAA or GAG) or an aspartic acid (via the codon GAT or GAC). Positions 117,203 to 117,205 of this wild type GPR156 genomic DNA (referring to SEQ ID NO:8) encode a glutamic acid (via the codon GAA or GAG).

In some embodiments, the nucleic acid molecule is genomic DNA. In some embodiments, the genomic DNA comprises or consists of a nucleic acid sequence of SEQ ID NO:9 (where positions 117,215 to 117,217 are GAT, thereby encoding an aspartic acid) or SEQ ID NO:10 (where positions 117,215 to 117,217 are GAC, thereby encoding an aspartic acid), or a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:9 (and comprises the GAT codon at the position corresponding to the position encoding the aspartic acid at position 533 according to SEQ ID NO:4) or SEQ ID NO:10 (and comprises the GAC codon at the position corresponding to the position encoding the aspartic acid at position 533 according to SEQ ID NO:4). In some embodiments, positions 117,164 to 117,166 of these GPR156 genomic DNAs (referring to SEQ ID NO:9 and SEQ ID NO:10) encode a glutamic acid (via the codon GAA or GAG). In some embodiments, the positions corresponding to positions 117,164 to 117,166 of these GPR156 genomic DNAs (referring to SEQ ID NO:9 and SEQ ID NO:10) encode an aspartic acid (via the codon GAT or GAC).

In some embodiments, the genomic DNA comprises or consists of a nucleic acid sequence of SEQ ID NO:11 or SEQ ID NO:12, each of which contains a deletion of 12 nucleotides at positions corresponding to positions 98,428 to 98,439 of SEQ ID NO:9 and SEQ ID NO:10, respectively. In some embodiments, the genomic DNA comprises or consists of a nucleic acid sequence set forth in SEQ ID NO:11, where positions 117,203 to 117,205 are GAT, thereby encoding an aspartic acid. In some embodiments, the genomic DNA comprises or consists of a nucleic acid sequence set forth in SEQ ID NO:12,where positions 117,203 to 117,205 are GAC, thereby encoding an aspartic acid. In some embodiments, the genomic DNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:11 (and comprises the GAT codon at the position corresponding to the position encoding the aspartic acid at position 529 according to SEQ ID NO:5) or SEQ ID NO:12 (and comprises the GAC codon at the position corresponding to the position encoding the aspartic acid at position 529 according to SEQ ID NO:5). In some embodiments, the positions corresponding to positions 117,152 to 117,154 of these GPR156 genomic DNAs (referring to SEQ ID NO:11 and SEQ ID NO:12) encode a glutamic acid (via the codon GAA or GAG). In some embodiments, the positions corresponding to positions 117,152 to 117,154 of these GPR156 genomic DNAs (referring to SEQ ID NO:11 and SEQ ID NO:12) encode an aspartic acid (via the codon GAT or GAC).

In some embodiments, the isolated nucleic acid molecules comprise less than the entire genomic DNA sequence. In some embodiments, the isolated nucleic acid molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 2000, at least about 3000, at least about 4000, at least about 5000, at least about 6000, at least about 7000, at least about 8000, at least about 9000, at least about 10000, at least about 11000, at least about 12000, at least about 13000, at least about 14000, at least about 15000, at least about 16000, at least about 17000, at least about 18000, at least about 19000, or at least about 20000 contiguous nucleotides of SEQ ID NO:9, SEQ ID NO:10, SEQ ID NO:11, or SEQ ID NO:12. In some embodiments, the isolated nucleic acid molecules comprise or consist of at least about 1000 to at least about 2000 contiguous nucleotides of SEQ ID NO:9, SEQ ID NO:10, SEQ ID NO:11, or SEQ ID NO:12.

In some embodiments, the isolated nucleic acid molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 1000, at least about 1100, at least about 1200, at least about 1300, at least about 1400, at least about 1500, at least about 1600, at least about 1700, at least about 1800, at least about 1900, at least about 2000, at least about 2100, at least about 2200, at least about 2300, or at least about 2400 contiguous nucleotides of SEQ ID NO:9, SEQ ID NO:10, SEQ ID NO:11, or SEQ ID NO:12. In some embodiments, such contiguous nucleotides may be combined with other nucleic acid molecules of contiguous nucleotides to produce the cDNA molecules described herein.

Such isolated nucleic acid molecules can be used, for example, to express variant GPR156 mRNAs and proteins or as exogenous donor sequences. It is understood that gene sequences within a population can vary due to polymorphisms, such as SNPs. The examples provided herein are only exemplary sequences, and other sequences are also possible.

In some embodiments, the isolated nucleic acid molecules comprise a variant GPR156 minigene, in which one or more nonessential segments encoding SEQ ID NO:4 or SEQ ID NO:5 have been deleted with respect to a corresponding wild type GPR156 gene. In some embodiments, the deleted nonessential segments comprise one or more intron sequences. In some embodiments, the GPR156 minigene has at least about 70%, at least about 75%, at least about 80%, at least about 85%, at least about 90%, at least about 95%, at least about 96%, at least about 97%, at least about 98%, at least about 99%, or 100% sequence identity to a portion of SEQ ID NO:9, SEQ ID NO:10, SEQ ID NO:11, or SEQ ID NO:12, wherein the minigene comprises aspartic acid at the position corresponding to position 533 according to SEQ ID NO:4.

The nucleic acid sequences for two wild type GPR156 cDNAs are set forth in SEQ ID NO:13. Positions 1546 to 1548 of these wild type GPR156 cDNAs (referring to SEQ ID NO:13) encode either a glutamic acid (via the codon GAA or GAG) or an aspartic acid (via the codon GAT or GAC). Positions 1597 to 1599 of these wild type GPR156 cDNAs (referring to SEQ ID NO:13) encode a glutamic acid (via the codon GAA or GAG).

The nucleic acid sequence of another wild type GPR156 cDNA is set forth in SEQ ID NO:14 (which contains a deletion of 12 nucleotides at positions corresponding to positions 592-603 of SEQ ID NO:13). Positions 1534 to 1536 of this wild type GPR156 cDNA (referring to SEQ ID NO:14) encode either a glutamic acid (via the codon GAA or GAG) or an aspartic acid (via the codon GAT or GAC). Positions 1585 to 1587 of this wild type GPR156 cDNA (referring to SEQ ID NO:14) encode a glutamic acid (via the codon GAA or GAG).

The nucleic acid sequence of a GPR156 cDNA encoding positions 310 to 814 of SEQ ID NO:4 is set forth in SEQ ID NO:15. This sequence corresponds to the cytoplasmic domain of GPR156. Positions 619 to 621 of this GPR156 cDNA (referring to SEQ ID NO:15) encode either a glutamic acid (via the codon GAA or GAG) or an aspartic acid (via the codon GAT or GAC). Positions 670 to 672 of this GPR156 cDNA (referring to SEQ ID NO:15) encode a glutamic acid (via the codon GAA or GAG).

The present disclosure also provides cDNA molecules. The present disclosure provides a cDNA molecule comprising a nucleic acid sequence encoding at least a portion of the human GPR156 protein, wherein the portion comprises an aspartic acid at the position corresponding to position 533 according to SEQ ID NO:4. In some embodiments, the cDNA molecule comprises a nucleic acid sequence encoding at least a portion of the human GPR156 protein, wherein the portion comprises an aspartic acid at the position corresponding to position 529 according to SEQ ID NO:5.

In some embodiments, the cDNA encodes a full length human GPR156 protein comprising an aspartic acid at the position corresponding to position 533 according to SEQ ID NO:4. In some embodiments, the cDNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:4, wherein the GPR156 protein comprises an aspartic acid at the position corresponding to position 533 according to SEQ ID NO:4.

In some embodiments, the cDNA encodes a human GPR156 protein comprising an aspartic acid at the position corresponding to position 529 according to SEQ ID NO:5. In some embodiments, the cDNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:5, wherein the GPR156 protein comprises an aspartic acid at the position corresponding to position 529 according to SEQ ID NO:5.

In some embodiments, the cDNA encodes the portion of the GPR156 protein corresponding to positions 310 to 814 of SEQ ID NO:4. In some embodiments, the cDNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to the portion of the GPR156 protein corresponding to positions 310 to 814 of SEQ ID NO:4, wherein the polypeptide comprises an aspartic acid at the position corresponding to position 533 according to SEQ ID NO:4.

In some embodiments, the cDNA encodes the portion of the GPR156 protein corresponding to positions 310 to 814 of SEQ ID NO:5. In some embodiments, the cDNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to the portion of the GPR156 protein corresponding to positions 310 to 814 of SEQ ID NO:5, wherein the polypeptide comprises an aspartic acid at the position corresponding to position 533 according to SEQ ID NO:5.

In some embodiments, the cDNA comprises or consists of a nucleic acid sequence of SEQ ID NO:16, where positions 1597 to 1599 are GAT, thereby encoding an aspartic acid. In some embodiments, the cDNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:16, and comprises the GAT codon at the position corresponding to the position encoding the aspartic acid at position 533 according to SEQ ID NO:4). In some embodiments, the positions corresponding to positions 1546 to 1548 of the GPR156 cDNA (referring to SEQ ID NO:16) encode a glutamic acid. In some embodiments, the positions corresponding to positions 1546 to 1548 of the GPR156 cDNA (referring to SEQ ID NO:16) encode an aspartic acid. In some embodiments, the cDNA comprises a thymine at the position corresponding to position 1599 of the GPR156 cDNA (referring to SEQ ID NO:16). This thymine corresponds to the third position of the codon encoding the aspartic acid at the position corresponding to position 533 according to SEQ ID NO:4).

In some embodiments, the cDNA comprises or consists of a nucleic acid sequence of SEQ ID NO:17, where positions 1597 to 1599 are GAC, thereby encoding an aspartic acid. In some embodiments, the cDNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:17, and comprises the GAC codon at the position corresponding to the position encoding the aspartic acid at position 533 according to SEQ ID NO:4). In some embodiments, the positions corresponding to positions 1546 to 1548 of the GPR156 cDNA (referring to SEQ ID NO:17) encode a glutamic acid. In some embodiments, positions 1546 to 1548 of the GPR156 cDNA (referring to SEQ ID NO:17) encode an aspartic acid. In some embodiments, the cDNA comprises a cytosine at the position corresponding to position 1599 of the GPR156 cDNA (referring to SEQ ID NO:17). This cytosine corresponds to the third position of the codon encoding the aspartic acid at the position corresponding to position 533 according to SEQ ID NO:4).

In some embodiments, the cDNA comprises or consists of a nucleic acid sequence of SEQ ID NO:18, which contains a deletion of 12 nucleotides at positions corresponding to positions 592 to 603 of SEQ ID NO:16. In some embodiments, the cDNA comprises or consists of a nucleic acid sequence set forth in SEQ ID NO:18, where positions 1585 to 1587 are GAT, thereby encoding an aspartic acid. In some embodiments, the cDNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:18 (and comprises the GAT codon at the position corresponding to the position encoding the aspartic acid at the position corresponding to position 529 according to SEQ ID NO:5). In some embodiments, the positions corresponding to positions 1534 to 1536 of this GPR156 cDNA (referring to SEQ ID NO:18) encode a glutamic acid (via the codon GAA or GAG). In some embodiments, the positions corresponding to positions 1534 to 1536 of this GPR156 cDNA (referring to SEQ ID NO:18) encode an aspartic acid (via the codon GAT or GAC). In some embodiments, the cDNA comprises a thymine at the position corresponding to position 1587 of the GPR156 cDNA (referring to SEQ ID NO:18). This thymine corresponds to the third position of the codon encoding the aspartic acid at the position corresponding to position 529 according to SEQ ID NO:5).

In some embodiments, the cDNA comprises or consists of a nucleic acid sequence of SEQ ID NO:19, which contains a deletion of 12 nucleotides at positions corresponding to positions 592 to 603 of SEQ ID NO:17. In some embodiments, the cDNA comprises or consists of a nucleic acid sequence set forth in SEQ ID NO:19, where positions 1585 to 1587 are GAC, thereby encoding an aspartic acid. In some embodiments, the cDNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:19 (and comprises the GAC codon at the position corresponding to the position encoding the aspartic acid at position 529 according to SEQ ID NO:5). In some embodiments, the positions corresponding to positions 1534 to 1536 of this GPR156 cDNA (referring to SEQ ID NO:19) encode a glutamic acid (via the codon GAA or GAG). In some embodiments, the positions corresponding to positions 1534 to 1536 of this GPR156 cDNA (referring to SEQ ID NO:19) encode an aspartic acid (via the codon GAT or GAC). In some embodiments, the cDNA comprises a cytosine at the position corresponding to position 1587 of the cDNA (referring to SEQ ID NO:19). This cytosine corresponds to the third position of the codon encoding the aspartic acid at the position corresponding to position 529 according to SEQ ID NO:5).

The cytoplasmic domain of GPR156 is encoded by positions 310 to 814 of GPR156. In some embodiments, the cDNA encodes positions 310 to 814 of SEQ ID NO:4. In some embodiments, the nucleic acid sequence of this cDNA is set forth in SEQ ID NO:20, wherein positions 670 to 672 encode an aspartic acid (via the codon GAT). In some embodiments, the cDNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:20, and comprises the GAT codon at the position corresponding to the position encoding the aspartic acid at the position corresponding to position 533 according to SEQ ID NO:4. In some embodiments, the positions corresponding to positions 619 to 621 of the GPR156 cDNA (referring to SEQ ID NO:20) encode a glutamic acid. In some embodiments, the positions corresponding to positions 619 to 621 of the GPR156 cDNA (referring to SEQ ID NO:20) encode an aspartic acid. In some embodiments, the cDNA comprises a thymine at the position corresponding to position 672 of the cDNA (referring to SEQ ID NO:20). This thymine corresponds to the third position of the codon encoding the aspartic acid at the position corresponding to position 533 according to SEQ ID NO:4).

In some embodiments, the nucleic acid sequence of the cDNA encoding positions 310 to 814 of SEQ ID NO:4 is set forth in SEQ ID NO:21, wherein positions 670 to 672 encode an aspartic acid (via the codon GAC). In some embodiments, the cDNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:21, and comprises the GAC codon at the position corresponding to the position encoding the aspartic acid at the position corresponding to position 533 according to SEQ ID NO:4. In some embodiments, the positions corresponding to positions 619 to 621 of the GPR156 cDNA (referring to SEQ ID NO:21) encode a glutamic acid. In some embodiments, the positions corresponding to positions 619 to 621 of the GPR156 cDNA (referring to SEQ ID NO:21) encode an aspartic acid. In some embodiments, the cDNA comprises a cytosine at the position corresponding to position 672 of the cDNA (referring to SEQ ID NO:21). This cytosine corresponds to the third position of the codon encoding the aspartic acid at the position corresponding to position 533 according to SEQ ID NO:4).

In some embodiments, the isolated nucleic acid molecules comprise a nucleic acid sequence comprising positions 1521 through 1680 of any of the cDNA or mRNA molecules disclosed herein, having a thymine at the position corresponding to position 1599.

In some embodiments, the cDNA molecules comprise less than the entire cDNA sequence of GPR156. In some embodiments, the cDNA molecules comprise or consist of at least about 5, at least about 8, at least about 10, at least about 12, at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 1100, at least about 1200, at least about 1300, at least about 1400, at least about 1500, at least about 1600, at least about 1700, at least about 1800, at least about 1900, at least about 2000, at least about 2100, at least about 2200, at least about 2300, or at least about 2400 contiguous nucleotides of SEQ ID NO:16, SEQ ID NO:17, SEQ ID NO:18, SEQ ID NO:19, SEQ ID NO:20, or SEQ ID NO:21. In some embodiments, the cDNA molecule comprises or consists of at least about 1000 to at least about 2000 contiguous nucleotides of SEQ ID NO:16, SEQ ID NO:17, SEQ ID NO:18, SEQ ID NO:19, SEQ ID NO:20, or SEQ ID NO:21. In this regard, the longer cDNA molecules are preferred over the shorter ones. In some embodiments, the cDNA molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, or at least about 500 contiguous nucleotides of SEQ ID NO:16, SEQ ID NO:17, SEQ ID NO:18, SEQ ID NO:19, SEQ ID NO:20, or SEQ ID NO:21. In this regard, the longer cDNA molecules are preferred over the shorter ones. In some embodiments, such cDNA molecules include the codon that encodes the aspartic acid at the position that corresponds to position 533 according to SEQ ID NO:4, or includes a thymine or cysteine at the position corresponding to position 1599 according to SEQ ID NO:16 or SEQ ID NO:17, respectively.

The nucleic acid sequences for two wild type GPR156 mRNAs are set forth in SEQ ID NO:22. Positions 1546 to 1548 of these wild type GPR156 mRNAs (referring to SEQ ID NO:22) encode either a glutamic acid (via the codon GAA or GAG) or an aspartic acid (via the codon GAU or GAC). Positions 1597 to 1599 of these wild type GPR156 mRNAs (referring to SEQ ID NO:22) encode a glutamic acid (via the codon GAA or GAG).

The nucleic acid sequence of another wild type GPR156 mRNA is set forth in SEQ ID NO:23 (which contains a deletion of 12 nucleotides at positions corresponding to positions 592 to 603 of SEQ ID NO:22). Positions 1534 to 1536 of this wild type GPR156 mRNA (referring to SEQ ID NO:23) encode either a glutamic acid (via the codon GAA or GAG) or an aspartic acid (via the codon GAU or GAC). Positions 1585 to 1587 of this wild type GPR156 mRNA (referring to SEQ ID NO:23) encode a glutamic acid (via the codon GAA or GAG).

The nucleic acid sequence of a GPR156 mRNA encoding positions 310 to 814 of SEQ ID NO:4 is set forth in SEQ ID NO:24. Positions 619 to 621 of this GPR156 mRNA (referring to SEQ ID NO:24) encode either a glutamic acid (via the codon GAA or GAG) or an aspartic acid (via the codon GAU or GAC). Positions 670 to 672 of this GPR156 mRNA (referring to SEQ ID NO:24) encode a glutamic acid (via the codon GAA or GAG).

The present disclosure also provides mRNA molecules. The present disclosure provides mRNA molecules comprising a nucleic acid sequence encoding at least a portion of the human GPR156 protein, wherein the portion comprises an aspartic acid at the position corresponding to position 533 according to SEQ ID NO:4. In some embodiments, the mRNA molecules comprise a nucleic acid sequence encoding at least a portion of the human GPR156 protein, wherein the portion comprises an aspartic acid at the position corresponding to position 529 according to SEQ ID NO:5.

In some embodiments, the mRNA encodes a full length human GPR156 protein comprising an aspartic acid at the position corresponding to position 533 according to SEQ ID NO:4. In some embodiments, the mRNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:4, wherein the GPR156 protein comprises an aspartic acid at the position corresponding to position 533 according to SEQ ID NO:4.

In some embodiments, the mRNA encodes a human GPR156 protein comprising an aspartic acid at the position corresponding to position 529 according to SEQ ID NO:5. In some embodiments, the mRNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:5, wherein the GPR156 protein comprises an aspartic acid at the position corresponding to position 529 according to SEQ ID NO:5.

In some embodiments, the mRNA encodes the portion of the GPR156 protein corresponding to positions 310 to 814 of SEQ ID NO:4. In some embodiments, the mRNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to the portion of the GPR156 protein corresponding to positions 310 to 814 of SEQ ID NO:4, wherein the polypeptide comprises aspartic acid at the position corresponding to position 533 according to SEQ ID NO:4.

In some embodiments, the mRNA encodes the portion of the GPR156 protein corresponding to positions 310 to 814 of SEQ ID NO:5. In some embodiments, the mRNA comprises or consists of a nucleic acid sequence that encodes a polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to the portion of the GPR156 protein corresponding to positions 310 to 814 of SEQ ID NO:5, wherein the polypeptide comprises aspartic acid at the position corresponding to position 533 according to SEQ ID NO:5.

In some embodiments, the mRNA comprises or consists of a nucleic acid sequence of SEQ ID NO:25, where positions 1597 to 1599 are GAU, thereby encoding an aspartic acid. In some embodiments, the mRNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:25, and comprises the GAU codon at the position corresponding to the position encoding the aspartic acid at the position corresponding to position 533 according to SEQ ID NO:4). In some embodiments, the positions corresponding to positions 1546 to 1548 of the GPR156 mRNA (referring to SEQ ID NO:25) encode a glutamic acid. In some embodiments, the positions corresponding to positions 1546 to 1548 of the GPR156 mRNA (referring to SEQ ID NO:25) encode an aspartic acid. In some embodiments, the mRNA comprises a uracil at the position corresponding to position 1599 of the GPR156 mRNA (referring to SEQ ID NO:25). This uracil corresponds to the third position of the codon encoding the aspartic acid at the position corresponding to position 533 according to SEQ ID NO:4).

In some embodiments, the mRNA comprises or consists of a nucleic acid sequence of SEQ ID NO:26, where positions 1597 to 1599 are GAC, thereby encoding an aspartic acid. In some embodiments, the mRNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:26, and comprises the GAC codon at the position corresponding to the position encoding the aspartic acid at the position corresponding to position 533 according to SEQ ID NO:4). In some embodiments, the positions corresponding to positions 1546 to 1548 of the GPR156 mRNA (referring to SEQ ID NO:26) encode a glutamic acid. In some embodiments, the positions corresponding to positions 1546 to 1548 of the GPR156 mRNA (referring to SEQ ID NO:26) encode an aspartic acid. In some embodiments, the mRNA comprises a cytosine at the position corresponding to position 1599 of the GPR156 mRNA (referring to SEQ ID NO:26). This cytosine corresponds to the third position of the codon encoding the aspartic acid at the position corresponding to position 533 according to SEQ ID NO:4).

In some embodiments, the mRNA comprises or consists of a nucleic acid sequence of SEQ ID NO:27, which contains a deletion of 12 nucleotides at positions corresponding to positions 592 to 603 of SEQ ID NO:25. In some embodiments, the mRNA comprises or consists of a nucleic acid sequence set forth in SEQ ID NO:27, where positions 1585 to 1587 are GAU, thereby encoding an aspartic acid. In some embodiments, the mRNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:27 (and comprises the GAU codon at the position corresponding to the position encoding the aspartic acid at the position corresponding to position 529 according to SEQ ID NO:5). In some embodiments, the positions corresponding to positions 1534 to 1536 of this GPR156 mRNA (referring to SEQ ID NO:27) encode a glutamic acid (via the codon GAA or GAG). In some embodiments, the positions corresponding to positions 1534 to 1536 of this GPR156 mRNA (referring to SEQ ID NO:27) encode an aspartic acid (via the codon GAU or GAC). In some embodiments, the mRNA comprises a uracil at the position corresponding to position 1587 of the GPR156 mRNA (referring to SEQ ID NO:27). This uracil corresponds to the third position of the codon encoding the aspartic acid at the position corresponding to position 529 according to SEQ ID NO:5).

In some embodiments, the mRNA comprises or consists of a nucleic acid sequence of SEQ ID NO:28, which contains a deletion of 12 nucleotides at positions corresponding to positions 592 to 603 of SEQ ID NO:26. In some embodiments, the mRNA comprises or consists of a nucleic acid sequence set forth in SEQ ID NO:28, where positions 1585 to 1587 are GAC, thereby encoding an aspartic acid. In some embodiments, the mRNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:28 (and comprises the GAC codon at the position corresponding to the position encoding the aspartic acid at position 529 according to SEQ ID NO:5). In some embodiments, the positions corresponding to positions 1534 to 1536 of this GPR156 mRNA (referring to SEQ ID NO:28) encode a glutamic acid (via the codon GAA or GAG). In some embodiments, the positions corresponding to positions 1534 to 1536 of this GPR156 mRNA (referring to SEQ ID NO:28) encode an aspartic acid (via the codon GAU or GAC). In some embodiments, the mRNA comprises a cytosine at the position corresponding to position 1587 of the GPR156 mRNA (referring to SEQ ID NO:28). This cytosine corresponds to the third position of the codon encoding the aspartic acid at the position corresponding to position 529 according to SEQ ID NO:5).

In some embodiments, the mRNA encodes positions 310 to 814 of SEQ ID NO:4. In some embodiments, the nucleic acid sequence of this mRNA is set forth in SEQ ID NO:29, wherein positions 670 to 672 encode an aspartic acid (via the codon GAU). In some embodiments, the mRNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:29, and comprises the GAU codon at the position corresponding to the position encoding the aspartic acid at the position corresponding to position 533 according to SEQ ID NO:4. In some embodiments, the positions corresponding to positions 619 to 621 of the GPR156 mRNA (referring to SEQ ID NO:29) encode a glutamic acid. In some embodiments, the positions corresponding to positions 619 to 621 of the GPR156 mRNA (referring to SEQ ID NO:29) encode an aspartic acid. In some embodiments, the mRNA comprises a uracil at the position corresponding to position 672 of the GPR156 mRNA (referring to SEQ ID NO:29). This uracil corresponds to the third position of the codon encoding the aspartic acid at the position corresponding to position 533 according to SEQ ID NO:4).

In some embodiments, the nucleic acid sequence of the mRNA encoding positions 310 to 814 of SEQ ID NO:4 is set forth in SEQ ID NO:30, wherein positions 670 to 672 encode an aspartic acid (via the codon GAC). In some embodiments, the mRNA comprises or consists of a nucleic acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:30, and comprises the GAC codon at the position corresponding to the position encoding the aspartic acid at the position corresponding to position 533 according to SEQ ID NO:4. In some embodiments, the positions corresponding to positions 619 to 621 of the GPR156 mRNA (referring to SEQ ID NO:30) encode a glutamic acid. In some embodiments, the positions corresponding to positions 619 to 621 of the GPR156 mRNA (referring to SEQ ID NO:30) encode an aspartic acid. In some embodiments, the mRNA comprises a cytosine at the position corresponding to position 672 of the GPR156 mRNA (referring to SEQ ID NO:30). This cytosine corresponds to the third position of the codon encoding the aspartic acid at the position corresponding to position 533 according to SEQ ID NO:4).

In some embodiments, the isolated nucleic acid molecules comprising a nucleic acid sequence comprising positions 1521 through 1680 of any mRNA molecules disclosed herein, having a uracil at the position corresponding to position 1599.

In some embodiments, the isolated nucleic acid molecule comprises less nucleotides than the entire GPR156 mRNA sequence. In some embodiments, the isolated nucleic acid molecules comprise or consist of at least about 5, at least about 8, at least about 10, at least about 12, at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 1100, at least about 1200, at least about 1300, at least about 1400, at least about 1500, at least about 1600, at least about 1700, at least about 1800, at least about 1900, at least about 2000, at least about 2100, at least about 2200, at least about 2300, or at least about 2400 contiguous nucleotides of SEQ ID NO:25, SEQ ID NO:26, SEQ ID NO:27, SEQ ID NO:28, SEQ ID NO:29, or SEQ ID NO:30. In some embodiments, the isolated nucleic acid molecules comprise or consist of at least about 1000 to at least about 2000 contiguous nucleotides of SEQ ID NO:25, SEQ ID NO:26, SEQ ID NO:27, SEQ ID NO:28, SEQ ID NO:29, or SEQ ID NO:30. In this regard, the longer mRNA molecules are preferred over the shorter ones. In some embodiments, the isolated nucleic acid molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, or at least about 1000 contiguous nucleotides of SEQ ID NO:25, SEQ ID NO:26, SEQ ID NO:27, SEQ ID NO:28, SEQ ID NO:29, or SEQ ID NO:30. In this regard, the longer mRNA molecules are preferred over the shorter ones. In some embodiments, such mRNA molecules include the codon that encodes the aspartic acid at the position corresponding to position 533 according to SEQ ID NO:4, or includes a uracil or cysteine corresponding to position 1599 of SEQ ID NO:25 or SEQ ID NO:26, respectively.

The present disclosure also provides isolated nucleic acid molecules that hybridize to variant GPR156 genomic DNAs (such as SEQ ID NO:9, SEQ ID NO:10, SEQ ID NO:11, or SEQ ID NO:12), variant GPR156 minigenes, variant GPR156 cDNAs (such as SEQ ID NO:16, SEQ ID NO:17, SEQ ID NO:18, SEQ ID NO:19, SEQ ID NO:20, or SEQ ID NO:21), and/or variant GPR156 mRNAs (such as SEQ ID NO:25, SEQ ID NO:26, SEQ ID NO:27, SEQ ID NO:28, SEQ ID NO:29, or SEQ ID NO:30). In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, at least about 5000, at least about 6000, at least about 7000, at least about 8000, at least about 9000, at least about 10000, at least about 11000, at least about 12000, at least about 13000, at least about 14000, at least about 15000, at least about 16000, at least about 17000, at least about 18000, at least about 19000, or at least about 20000 nucleotides. In some embodiments, the isolated nucleic acid molecule comprises or consists of at least 15 nucleotides. In some embodiments, the isolated nucleic acid molecule comprises or consists of at least 15 nucleotides to at least about 35 nucleotides. In some embodiments, such isolated nucleic acid molecules hybridize to variant GPR156 genomic DNAs (such as SEQ ID NO:9, SEQ ID NO:10, SEQ ID NO:11, or SEQ ID NO:12), variant GPR156 minigenes, variant GPR156 cDNAs (such as SEQ ID NO:16, SEQ ID NO:17, SEQ ID NO:18, SEQ ID NO:19, SEQ ID NO:20, or SEQ ID NO:21), and/or variant GPR156 mRNAs (such as SEQ ID NO:25, SEQ ID NO:26, SEQ ID NO:27, SEQ ID NO:28, SEQ ID NO:29, or SEQ ID NO:30) under stringent conditions. Such nucleic acid molecules may be used, for example, as probes, as primers, or as allele-specific primers as described or exemplified herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to variant GPR156 genomic DNAs (such as SEQ ID NO:9, SEQ ID NO:10, SEQ ID NO:11, or SEQ ID NO:12), variant GPR156 minigenes, variant GPR156 cDNAs (such as SEQ ID NO:16, SEQ ID NO:17, SEQ ID NO:18, SEQ ID NO:19, SEQ ID NO:20, or SEQ ID NO:21), and/or variant GPR156 mRNAs (such as SEQ ID NO:25, SEQ ID NO:26, SEQ ID NO:27, SEQ ID NO:28, SEQ ID NO:29, or SEQ ID NO:30). In some embodiments, the isolated nucleic acid molecules comprise or consist of from about 15 to about 100 nucleotides, or from about 15 to about 35 nucleotides. In some embodiments, the isolated nucleic acid molecules comprise or consist of from about 15 to about 100 nucleotides. In some embodiments, the isolated nucleic acid molecules comprise or consist of from about 15 to about 35 nucleotides.

In some embodiments, any of the nucleic acid molecules, genomic DNA molecules, cDNA molecules, or mRNA molecules disclosed herein can be purified, e.g., are at least about 90% pure. In some embodiments, any of the nucleic acid molecules, genomic DNA molecules, cDNA molecules, or mRNA molecules disclosed herein can be purified, e.g., are at least about 95% pure. In some embodiments, any of the nucleic acid molecules, genomic DNA molecules, cDNA molecules, or mRNA molecules disclosed herein can be purified, e.g., are at least about 99% pure. Purification is according to the hands of a human being, with human-made purification techniques.

The present disclosure also provides fragments of any of the isolated nucleic acid molecules, genomic DNA molecules, cDNA molecules, or mRNA molecules disclosed herein. In some embodiments, the fragments comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 contiguous residues of any of the nucleic acid sequences disclosed herein, or any complement thereof. In this regard, the longer fragments are preferred over the shorter ones. In some embodiments, the fragments comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, or at least about 50 contiguous residues. In this regard, the longer fragments are preferred over the shorter ones. In some embodiments, the fragments comprise or consist of at least about 20, at least about 25, at least about 30, or at least about 35 contiguous residues. In some embodiments, the fragments comprise or consist of at least about 20 contiguous residues. In some embodiments, the fragments comprise or consist of at least about 25 contiguous residues. In some embodiments, the fragments comprise or consist of at least about 30 contiguous residues. In some embodiments, the fragments comprise or consist of at least about 35 contiguous residues. It is envisaged that the fragments comprise of consist of the portion of the nucleic acid molecule that encodes the aspartic acid at the position corresponding to position 533 of the protein having the amino acid sequence according to SEQ ID NO:4, or that encodes the aspartic acid at the position corresponding to position 529 of the protein having the amino acid sequence according to SEQ ID NO:5. Such fragments may be used, for example, as probes, as primers, or as allele-specific primers as described or exemplified herein.

The present disclosure also provides probes and primers. The probe or primer of the present disclosure have a nucleic acid sequence that specifically hybridizes to any of the nucleic acid molecules disclosed herein, or the complement thereof. In some embodiments, the probe or primer specifically hybridizes to any of the nucleic acid molecules disclosed herein under stringent conditions. The present disclosure also provides nucleic acid molecules having nucleic acid sequences that hybridize under moderate conditions to any of the nucleic acid molecules disclosed herein, or the complement thereof. A probe or primer according to the disclosure preferably encompasses the nucleic acid codon which encodes the E533D variation within the GPR156 protein, or the complement thereof. Thus, in a preferred embodiment, the disclosure provides allele-specific primers which are defined herein above and below in more detail.

A probe or primer according to the disclosure may be used to detect the E533D variation within the nucleic acid sequence encoding the GPR156 protein (e.g., according to SEQ ID NO:4) and/or the E529D mutation within the nucleic acid molecule encoding the isoform of GPR156 (e.g., according to SEQ ID NO:5). For example, a primer according to the disclosure may be used to amplify GPR156 or a fragment thereof comprising the E533D variation. A primer according to the disclosure may also be used to amplify a GPR156 isoform (such as the isoform having the amino acid sequence of SEQ ID NO:5) or a fragment thereof comprising the E529D mutation. Exemplified primers according to the disclosure are shown in Table 1.

The disclosure also provides a pair of primers comprising one of the primers described above. By using such a pair of primers length polymorphisms within GPR156 may also be detected. For example, a pair of primers may be used to distinguish the nucleic acid molecule encoding the canonical GPR156 protein (e.g. of SEQ ID NO:4) from the nucleic acid molecule encoding the GPR156 isoform which lacks four amino acids in the N-terminal to central region of the GPR156 protein (e.g. of SEQ ID NO:5). More specifically, if the positions where the primers hybridize flank the positions of the four amino acids that are lacking in the GPR156 isoform, then the amplified fragment which corresponds to the canonical GRP156 protein is longer as compared to the amplified fragment which corresponds to the GPR156 isoform.

The nucleic acid molecules disclosed herein can comprise a nucleic acid sequence of a naturally occurring GPR156 gene, cDNA, or mRNA transcript, or can comprise a non-naturally occurring sequence. In some embodiments, the naturally occurring sequence can differ from the non-naturally occurring sequence due to synonymous mutations or mutations that do not affect the encoded GPR156 polypeptide. For example, the sequence can be identical with the exception of synonymous mutations or mutations that do not affect the encoded GPR156 polypeptide. A synonymous mutation or substitution is the substitution of one nucleotide for another in an exon of a gene coding for a protein such that the produced amino acid sequence is not modified. This is possible because of the degeneracy of the genetic code, with some amino acids being coded for by more than one three-base pair codon. Synonymous substitutions are used, for example, in the process of codon optimization. The nucleic acid molecules disclosed herein can be codon optimized.

Also provided herein are functional polynucleotides that can interact with the disclosed nucleic acid molecules. Functional polynucleotides are nucleic acid molecules that have a specific function, such as binding a target molecule or catalyzing a specific reaction. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

Antisense molecules are designed to interact with a target nucleic acid molecule through either canonical or non-canonical base pairing. The interaction of the antisense molecule and the target molecule is designed to promote the destruction of the target molecule through, for example, RNase-H-mediated RNA-DNA hybrid degradation. Alternately, the antisense molecule is designed to interrupt a processing function that normally would take place on the target molecule, such as transcription or replication. Antisense molecules can be designed based on the sequence of the target molecule. Numerous methods for optimization of antisense efficiency by identifying the most accessible regions of the target molecule exist. Exemplary methods include, but are not limited to, in vitro selection experiments and DNA modification studies using DMS and DEPC. Antisense molecules generally bind the target molecule with a dissociation constant ($k_d$) less than or equal to about $10^{-6}$, less than or equal to about $10^{-8}$, less than or equal to about $10^{-10}$, or less than or equal to about $10^{-12}$. A representative sample of methods and techniques which aid in the design and use of antisense molecules can be found in the following non-limiting list of U.S. Pat. Nos. 5,135,917; 5,294,533; 5,627,158; 5,641,754; 5,691,317; 5,780,607; 5,786,138; 5,849,903; 5,856,103; 5,919,772; 5,955,590; 5,990,088; 5,994,320; 5,998,602; 6,005,095; 6,007,995; 6,013,522; 6,017,898; 6,018,042; 6,025,198; 6,033,910; 6,040,296; 6,046,004; 6,046,319; and 6,057,437. Examples of antisense molecules include, but are not limited to, antisense RNAs, small interfering RNAs (siRNAs), and short hairpin RNAs (shRNAs).

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be in a vector or exogenous donor sequence comprising the isolated nucleic acid molecule and a heterologous nucleic acid sequence. The isolated nucleic acid molecules can also be linked or fused to a heterologous label, such as a fluorescent label. Other examples of labels are disclosed elsewhere herein.

The label can be directly detectable (e.g., fluorophore) or indirectly detectable (e.g., hapten, enzyme, or fluorophore quencher). Such labels can be detectable by spectroscopic, photochemical, biochemical, immunochemical, or chemical means. Such labels include, for example, radiolabels that can be measured with radiation-counting devices; pigments, dyes or other chromogens that can be visually observed or measured with a spectrophotometer; spin labels that can be measured with a spin label analyzer; and fluorescent labels (e.g., fluorophores), where the output signal is generated by the excitation of a suitable molecular adduct and that can be visualized by excitation with light that is absorbed by the dye or can be measured with standard fluorometers or imaging systems. The label can also be, for example, a chemiluminescent substance, where the output signal is generated by chemical modification of the signal compound; a metal-containing substance; or an enzyme, where there occurs an enzyme-dependent secondary generation of signal, such as the formation of a colored product from a colorless substrate. The term "label" can also refer to a "tag" or hapten that can bind selectively to a conjugated molecule such that the conjugated molecule, when added subsequently along with a substrate, is used to generate a detectable signal. For example, one can use biotin as a tag and then use an avidin or streptavidin conjugate of horseradish peroxidate (HRP) to bind to the tag, and then use a calorimetric substrate (e.g., tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels are known and include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Certain nucleotide analogs such as, for example, 5-substituted pyrimidines, 6-azapyrimidines, and N-2, N-6 and O-6 substituted purines including, but not limited to, 2-aminopropyladenine, 5-propynyluracil, 5-propynylcytosine, and 5-methylcytosine can increase the stability of duplex formation. Often, base modifications can be combined with, for example, a sugar modification, such as 2'-O-methoxyethyl, to achieve unique properties such as increased duplex stability.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O—, S—, or N-alkyl; O—, S—, or N-alkenyl; O—, S— or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $—O[(CH_2)_nO]_mCH_3$, $—O(CH_2)_nOCH_3$, $—O(CH_2)_nNH_2$, $—O(CH_2)_nCH_3$, $—O(CH_2)_n—ONH_2$, and $—O(CH_2)_nON[(CH_2)_nCH_3)]_2$, where n and m are from 1 to about 10.

Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and —the linkage can contain inverted polarity such as 3'-5' to 5'-3' or 2'-5' to 5'-2'. Various salts, mixed salts, and free acid forms are also included.

Nucleotide substitutes include molecules having similar functional properties to nucleotides, but which do not contain a phosphate moiety, such as peptide nucleic acid (PNA). Nucleotide substitutes include molecules that will recognize nucleic acids in a Watson-Crick or Hoogsteen manner, but which are linked together through a moiety other than a phosphate moiety. Nucleotide substitutes are able to conform to a double helix type structure when interacting with the appropriate target nucleic acid.

Nucleotide substitutes also include nucleotides or nucleotide analogs that have had the phosphate moiety or sugar moieties replaced. In some embodiments, nucleotide substitutes may not contain a standard phosphorus atom. Substitutes for the phosphate can be, for example, short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

It is also understood in a nucleotide substitute that both the sugar and the phosphate moieties of the nucleotide can be replaced by, for example, an amide type linkage (aminoethylglycine) (PNA).

It is also possible to link other types of molecules (conjugates) to nucleotides or nucleotide analogs to enhance, for example, cellular uptake. Conjugates can be chemically linked to the nucleotide or nucleotide analogs. Such conjugates include, for example, lipid moieties such as a cholesterol moiety, cholic acid, a thioether such as hexyl-S-tritylthiol, a thiocholesterol, an aliphatic chain such as dodecandiol or undecyl residues, a phospholipid such as di-hexadecyl-rac-glycerol or triethylammonium 1,2-di-O-hexadecyl-rac-glycero-3-H-phosphonate, a polyamine or a polyethylene glycol chain, adamantane acetic acid, a palmityl moiety, or an octadecylamine or hexylamino-carbonyl-oxycholesterol moiety.

The present disclosure also provides vectors comprising any one or more of the nucleic acid molecules disclosed herein. In some embodiments, the vectors comprise any one or more of the nucleic acid molecules disclosed herein and a heterologous nucleic acid. The vectors can be viral or nonviral vectors capable of transporting a nucleic acid molecule. In some embodiments, the vector is a plasmid or cosmid (e.g., a circular double-stranded DNA into which additional DNA segments can be ligated). In some embodiments, the vector is a viral vector, wherein additional DNA segments can be ligated into the viral genome. In some embodiments, the vector can autonomously replicate in a host cell into which it is introduced (e.g., bacterial vectors having a bacterial origin of replication and episomal mammalian vectors). In some embodiments, the vector (e.g., non-episomal mammalian vectors) can be integrated into the genome of a host cell upon introduction into the host cell and thereby are replicated along with the host genome. Moreover, particular vectors can direct the expression of genes to which they are operatively linked. Such vectors are referred to herein as "recombinant expression vectors" or "expression vectors." Such vectors can also be targeting vectors (i.e., exogenous donor sequences).

In some embodiments, the proteins encoded by the various genetic variants disclosed herein are expressed by inserting nucleic acid molecules encoding the disclosed genetic variants into expression vectors, such that the genes are operatively linked to expression control sequences, such as transcriptional and translational control sequences. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art. In some embodiments, nucleic acid molecules comprising the disclosed genetic variants can be ligated into a vector such that transcriptional and translational control sequences within the vector serve their intended function of regulating the transcription and translation of the genetic variant. The expression vector and expression control sequences are chosen to be compatible with the expression host cell used. Nucleic acid sequences comprising the disclosed genetic variants can be inserted into separate vectors or into the same expression vector as the variant genetic information. A nucleic acid sequence comprising the disclosed genetic variants can be inserted into the expression vector by standard methods (e.g., ligation of complementary restriction sites on the nucleic acid comprising the disclosed genetic variants and vector, or blunt end ligation if no restriction sites are present).

In addition to a nucleic acid sequence comprising the disclosed genetic variants, the recombinant expression vectors can carry regulatory sequences that control the expression of the genetic variant in a host cell. The design of the expression vector, including the selection of regulatory sequences can depend on such factors as the choice of the host cell to be transformed, the level of expression of protein desired, and so forth. Desired regulatory sequences for mammalian host cell expression can include, for example, viral elements that direct high levels of protein expression in mammalian cells, such as promoters and/or enhancers derived from retroviral LTRs, cytomegalovirus (CMV) (such as the CMV promoter/enhancer), Simian Virus 40 (SV40) (such as the SV40 promoter/enhancer), adenovirus, (e.g., the adenovirus major late promoter (AdMLP)), polyoma and strong mammalian promoters such as native immunoglobulin and actin promoters. Methods of expressing polypeptides in bacterial cells or fungal cells (e.g., yeast cells) are also well known.

A promoter can be, for example, a constitutively active promoter, a conditional promoter, an inducible promoter, a temporally restricted promoter (e.g., a developmentally regulated promoter), or a spatially restricted promoter (e.g., a cell-specific or tissue-specific promoter). Examples of promoters can be found, for example, in WO 2013/176772.

Examples of inducible promoters include, for example, chemically regulated promoters and physically-regulated promoters. Chemically regulated promoters include, for example, alcohol-regulated promoters (e.g., an alcohol dehydrogenase (alcA) gene promoter), tetracycline-regulated promoters (e.g., a tetracycline-responsive promoter, a tetracycline operator sequence (tetO), a tet-On promoter, or a tet-Off promoter), steroid regulated promoters (e.g., a rat glucocorticoid receptor, a promoter of an estrogen receptor, or a promoter of an ecdysone receptor), or metal-regulated promoters (e.g., a metalloprotein promoter). Physically regulated promoters include, for example temperature-regulated promoters (e.g., a heat shock promoter) and light-regulated promoters (e.g., a light-inducible promoter or a light-repressible promoter).

Tissue-specific promoters can be, for example, neuron-specific promoters, glia-specific promoters, muscle cell-specific promoters, heart cell-specific promoters, kidney cell-specific promoters, bone cell-specific promoters, endothelial cell-specific promoters, or immune cell-specific promoters (e.g., a B cell promoter or a T cell promoter).

Developmentally regulated promoters include, for example, promoters active only during an embryonic stage of development, or only in an adult cell.

In addition to a nucleic acid sequence comprising the disclosed genetic variants and regulatory sequences, the recombinant expression vectors can carry additional sequences, such as sequences that regulate replication of the vector in host cells (e.g., origins of replication) and selectable marker genes. A selectable marker gene can facilitate selection of host cells into which the vector has been introduced (see e.g., U.S. Pat. Nos. 4,399,216; 4,634,665; and 5,179,017). For example, a selectable marker gene can confer resistance to drugs, such as G418, hygromycin, or methotrexate, on a host cell into which the vector has been introduced. Exemplary selectable marker genes include, but are not limited to, the dihydrofolate reductase (DHFR) gene (for use in dhfr-host cells with methotrexate selection/amplification), the neo gene (for G418 selection), and the glutamate synthetase (GS) gene.

Additional vectors are described in, for example, U.S. Provisional Application No. 62/367,973, filed on Jul. 28, 2016, which is incorporated herein by reference in its entirety.

The present disclosure also provides compositions comprising any one or more of the isolated nucleic acid molecules, genomic DNA molecules, cDNA molecules, or mRNA molecules disclosed herein. In some embodiments, the composition is a pharmaceutical composition.

The present disclosure also provides variant GPR156 polypeptides. The present disclosure provides isolated or recombinant polypeptides comprising at least a portion of the GPR156 protein, wherein the portion comprises an aspartic acid at the position corresponding to position 533 according to SEQ ID NO:4. In some embodiments, the isolated or recombinant polypeptides comprise at least a portion of the GPR156 protein, wherein the portion comprises an aspartic acid at the position corresponding to position 529 according to SEQ ID NO:5.

In some embodiments, the isolated or recombinant polypeptide comprises or consists of an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:4, wherein the amino acid at the position corresponding to position 533 (according to SE ID NO:4) of the polypeptide is an aspartic acid. In some embodiments, the polypeptide comprises a full-length GPR156 protein comprising an aspartic acid at the position corresponding to position 533 according to SEQ ID NO:4. In some embodiments, the full-length GPR156 protein comprises or consists of an amino acid sequence that has at least about 90%, about 91%, about 92%, about 93%, about 94%, about 95%, about 96%, about 97%, about 98%, or about 99% sequence identity to SEQ ID NO:4, wherein the amino acid at the position corresponding to position 533 (according to SEQ ID NO:4) of the polypeptide is an aspartic acid. In some embodiments, the polypeptide comprises the amino acid sequence of SEQ ID NO:4. In some embodiments, the polypeptide consists of the amino acid sequence of SEQ ID NO:4. The position corresponding to Position 516 of this variant GPR156 protein (referring to SEQ ID NO:4) is either a glutamic acid or an aspartic acid. In some embodiments, the position corresponding to Position 516 of this variant GPR156 protein (referring to SEQ ID NO:4) is a glutamic acid. In some embodiments, the position corresponding to Position 516 of this variant GPR156 protein (referring to SEQ ID NO:4) is an aspartic acid.

In some embodiments, the isolated or recombinant polypeptide comprises or consists of an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:5, wherein the amino acid at the position corresponding to position 529 (according to SEQ ID NO:5) of the polypeptide is an aspartic acid. In some embodiments, the polypeptide comprises a GPR156 protein comprising an aspartic acid at the position corresponding to position 529 according to SEQ ID NO:5. In some embodiments, the GPR156 protein comprises or consists of an amino acid sequence that has at least about 90%, about 91%, about 92%, about 93%, about 94%, about 95%, about 96%, about 97%, about 98%, or about 99% sequence identity to SEQ ID NO:5, wherein the amino acid at the position corresponding to position 529 (according to SEQ ID NO:5) of the polypeptide is an aspartic acid. In some embodiments, the polypeptide comprises the amino acid sequence of SEQ ID NO:5. In some embodiments, the polypeptide consists of the amino acid sequence of SEQ ID NO:5. The position corresponding to position 512 of this variant GPR156 protein (referring to SEQ ID NO:5) is either a glutamic acid or an aspartic acid. In some embodiments, the position corresponding to position 512 of this variant GPR156 protein (referring to SEQ ID NO:5) is a glutamic acid. In some embodiments, the position corresponding to position 512 of this variant GPR156 protein (referring to SEQ ID NO:5) is an aspartic acid.

In some embodiments, the polypeptide comprises the portion of the GPR156 protein corresponding to positions 310 to 814 of SEQ ID NO:4. In some embodiments, the polypeptide comprises or consists of an amino acid sequence that has at least about 90%, at least about 91%, at least about 92%, at least about 93%, at least about 94%, at least about 95%, at least about 96%, at least about 97%, at least about 98%, or at least about 99% sequence identity to positions 310 to 814 of SEQ ID NO:4, wherein the amino acid at the position (e.g., position 224) corresponding to position 533 according to SEQ ID NO:4 is an aspartic acid. In some embodiments, the polypeptide comprises the amino acid sequence of SEQ ID NO:6. In some embodiments, the polypeptide consists of the amino acid sequence of SEQ ID NO:6. The position corresponding to position 207 of this GPR156 protein (referring to SEQ ID NO:6) is either a glutamic acid or an aspartic acid. In some embodiments, the position corresponding to position 207 of this GPR156 protein (referring to SEQ ID NO:6) is a glutamic acid. In some embodiments, the position corresponding to position 207 of this GPR156 protein (referring to SEQ ID NO:6) is an aspartic acid.

The present disclosure also provides fragments of any of the polypeptides disclosed herein. In some embodiments, the fragments comprise at least about 10, at least about 15, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 150, at least about 200, at least about 250, at least about 300, at least about 350, at least about 400, at least about 450, at least about 500, at least about 550, at least about 600, at least about 650, at least about 700, at least about 750, or at least about 800 contiguous amino acid residues of the encoded polypeptide. In this regard, the longer fragments are preferred over the shorter ones. In some embodiments, the fragments comprise at least about 10, at least about 15, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 contiguous amino acid residues of the encoded polypeptide. In this regard, the longer fragments are preferred over the shorter ones.

The present disclosure also provides dimers comprising an isolated polypeptide comprising a variant GPR156 wherein the polypeptide is selected from any of the polypeptides disclosed herein.

In some embodiments, the isolated polypeptides disclosed herein are linked or fused to heterologous polypeptides or heterologous molecules or labels, numerous examples of which are disclosed elsewhere herein. For example, the proteins can be fused to a heterologous polypeptide providing increased or decreased stability. The fused domain or heterologous polypeptide can be located at the N-terminus, the C-terminus, or internally within the polypeptide. A fusion partner may, for example, assist in providing T helper epitopes (an immunological fusion partner), or may assist in expressing the protein (an expression enhancer) at higher yields than the native recombinant polypeptide. Certain fusion partners are both immunological and expression enhancing fusion partners. Other fusion partners may be selected to increase the solubility of the polypeptide or to facilitate targeting the polypeptide to desired intracellular compartments. Some fusion partners include affinity tags, which facilitate purification of the polypeptide.

In some embodiments, a fusion protein is directly fused to the heterologous molecule or is linked to the heterologous molecule via a linker, such as a peptide linker. Suitable peptide linker sequences may be chosen, for example, based on the following factors: 1) the ability to adopt a flexible extended conformation; 2) the resistance to adopt a secondary structure that could interact with functional epitopes on the first and second polypeptides; and 3) the lack of hydrophobic or charged residues that might react with the polypeptide functional epitopes. For example, peptide linker sequences may contain Gly, Asn and Ser residues. Other near neutral amino acids, such as Thr and Ala may also be used in the linker sequence. Amino acid sequences which may be usefully employed as linkers include those disclosed in, for example, Maratea et al., *Gene,* 1985, 40, 39-46; Murphy et al., *Proc. Natl. Acad. Sci. USA,* 1986, 83, 8258-8262; and U.S. Pat. Nos. 4,935,233 and 4,751,180. A linker sequence may generally be, for example, from 1 to about 50 amino acids in length. Linker sequences are generally not required when the first and second polypeptides have non-essential N-terminal amino acid regions that can be used to separate the functional domains and prevent steric interference.

In some embodiments, the polypeptides are operably linked to a cell-penetrating domain. For example, the cell-penetrating domain can be derived from the HIV-1 TAT protein, the TLM cell-penetrating motif from human hepatitis B virus, MPG, Pep-1, VP22, a cell-penetrating peptide from Herpes simplex virus, or a polyarginine peptide sequence. See, e.g., WO 2014/089290. The cell-penetrating domain can be located at the N-terminus, the C-terminus, or anywhere within the protein.

In some embodiments, the polypeptides are operably linked to a heterologous polypeptide for ease of tracking or purification, such as a fluorescent protein, a purification tag, or an epitope tag. Examples of fluorescent proteins include, but are not limited to, green fluorescent proteins (e.g., GFP, GFP-2, tagGFP, turboGFP, eGFP, Emerald, Azami Green, Monomeric Azami Green, CopGFP, AceGFP, ZsGreenl), yellow fluorescent proteins (e.g., YFP, eYFP, Citrine, Venus, YPet, PhiYFP, ZsYellowl), blue fluorescent proteins (e.g., eBFP, eBFP2, Azurite, mKalamal, GFPuv, Sapphire, T-sapphire), cyan fluorescent proteins (e.g., eCFP, Cerulean, CyPet, AmCyanl, Midoriishi-Cyan), red fluorescent proteins (e.g., mKate, mKate2, mPlum, DsRed monomer, mCherry, mRFP1, DsRed-Express, DsRed2, DsRed-Monomer, HcRed-Tandem, HcRedI, AsRed2, eqFP611, mRaspberry, mStrawberry, Jred), orange fluorescent proteins (e.g., mOrange, mKO, Kusabira-Orange, Monomeric Kusabira-Orange, mTangerine, tdTomato), and any other suitable fluorescent protein. Examples of tags include, but are not limited to, glutathione-S-transferase (GST), chitin binding protein (CBP), maltose binding protein, thioredoxin (TRX), poly (NANP), tandem affinity purification (TAP) tag, myc, AcV5, AU1, AUS, E, ECS, E2, FLAG, hemagglutinin (HA), nus, Softag 1, Softag 3, Strep, SBP, Glu-Glu, HSV, KT3, S, S1, T7, V5, VSV-G, histidine (His), biotin carboxyl carrier protein (BCCP), and calmodulin. In some embodiments, the heterologous molecule is an immunoglobulin Fc domain, a peptide tag, a transduction domain, poly(ethylene glycol), polysialic acid, or glycolic acid.

In some embodiments, the isolated polypeptides comprise non-natural or modified amino acids or peptide analogs. For example, there are numerous D-amino acids or amino acids which have a different functional substituent than the naturally occurring amino acids. The opposite stereo isomers of naturally occurring peptides are disclosed, as well as the stereo isomers of peptide analogs. These amino acids can readily be incorporated into polypeptide chains by charging tRNA molecules with the amino acid of choice and engineering genetic constructs that utilize, for example, amber codons, to insert the analog amino acid into a peptide chain in a site-specific way.

In some embodiments, the isolated polypeptides are peptide mimetics, which can be produced to resemble peptides, but which are not connected via a natural peptide linkage. For example, linkages for amino acids or amino acid analogs include, but are not limited to, —$CH_2$NH—, —$CH_2$S—, —$CH_2$—, —CH═CH— (cis and trans), —$COCH_2$—, —CH(OH)$CH_2$—, and —$CHH_2$SO—. Peptide analogs can have more than one atom between the bond atoms, such as b-alanine, gaminobutyric acid, and the like. Amino acid analogs and peptide analogs often have enhanced or desirable properties, such as, more economical production, greater chemical stability, enhanced pharmacological properties (half-life, absorption, potency, efficacy, and so forth), altered specificity (e.g., a broad-spectrum of biological activities), reduced antigenicity, and others desirable properties.

In some embodiments, the isolated polypeptides comprise D-amino acids, which can be used to generate more stable peptides because D amino acids are not recognized by peptidases. Systematic substitution of one or more amino acids of a consensus sequence with a D-amino acid of the same type (e.g., D-lysine in place of L-lysine) can be used to generate more stable peptides. Cysteine residues can be used to cyclize or attach two or more peptides together. This can be beneficial to constrain peptides into particular conformations (see, e.g., Rizo and Gierasch, *Ann. Rev. Biochem.,* 1992, 61, 387).

The present disclosure also provides nucleic acid molecules encoding any of the polypeptides disclosed herein. This includes all degenerate sequences related to a specific polypeptide sequence (all nucleic acids having a sequence that encodes one particular polypeptide sequence as well as all nucleic acids, including degenerate nucleic acids, encoding the disclosed variants and derivatives of the protein sequences). Thus, while each particular nucleic acid sequence may not be written out herein, each and every sequence is in fact disclosed and described herein through the disclosed polypeptide sequences.

Percent identity (or percent complementarity) between particular stretches of nucleic acid sequences within nucleic acids or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

The present disclosure also provides compositions comprising any one or more of the nucleic acid molecules and/or any one or more of the polypeptides disclosed herein and a carrier and/or excipient. In some embodiments, the carrier increases the stability of the nucleic acid molecule and/or polypeptide (e.g., prolonging the period under given conditions of storage (e.g., −20'C., 4'C., or ambient temperature) for which degradation products remain below a threshold, such as below 0.5% by weight of the starting nucleic acid or protein; or increasing the stability in vivo). Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

The present disclosure also provides methods of producing any of the polypeptides or fragments thereof disclosed herein. Such polypeptides or fragments thereof can be produced by any suitable method. For example, polypeptides or fragments thereof can be produced from host cells comprising nucleic acid molecules (e.g., recombinant expression vectors) encoding such polypeptides or fragments thereof. Such methods can comprise culturing a host cell comprising a nucleic acid molecule (e.g., recombinant expression vector) encoding a polypeptide or fragment thereof under conditions sufficient to produce the polypeptide or fragment thereof, thereby producing the polypeptide or fragment thereof. The nucleic acid can be operably linked to a promoter active in the host cell, and the culturing can be carried out under conditions whereby the nucleic acid is expressed. Such methods can further comprise recovering the expressed polypeptide or fragment thereof. The recovering can further comprise purifying the polypeptide or fragment thereof.

Examples of suitable systems for protein expression include host cells such as, for example: bacterial cell expression systems (e.g., *Escherichia coli, Lactococcus lactis*), yeast cell expression systems (e.g., *Saccharomyces cerevisiae, Pichia pastoris*), insect cell expression systems (e.g., baculovirus-mediated protein expression), and mammalian cell expression systems.

Examples of nucleic acid molecules encoding polypeptides or fragments thereof are disclosed in more detail elsewhere herein. In some embodiments, the nucleic acid molecules are codon optimized for expression in the host cell. In some embodiments, the nucleic acid molecules are operably linked to a promoter active in the host cell. The promoter can be a heterologous promoter (e.g., a promoter than is not a naturally occurring promoter). Examples of promoters suitable for *Escherichia coli* include, but are not limited to, arabinose, lac, tac, and T7 promoters. Examples of promoters suitable for *Lactococcus lactis* include, but are not limited to, P170 and nisin promoters. Examples of promoters suitable for *Saccharomyces cerevisiae* include, but are not limited to, constitutive promoters such as alcohol dehydrogenase (ADHI) or enolase (ENO) promoters or inducible promoters such as PHO, CUP1, GAL1, and G10. Examples of promoters suitable for *Pichia pastoris* include, but are not limited to, the alcohol oxidase I (AOX I) promoter, the glyceraldehyde 3 phosphate dehydrogenase (GAP) promoter, and the glutathione dependent formaldehyde dehydrogenase (FLDI) promoter. An example of a promoter suitable for a baculovirus-mediated system is the late viral strong polyhedrin promoter.

In some embodiments, the nucleic acid molecules encode a tag in frame with the polypeptide or fragment thereof to facilitate protein purification. Examples of tags are disclosed elsewhere herein. Such tags can, for example, bind to a partner ligand (e.g., immobilized on a resin) such that the tagged protein can be isolated from all other proteins (e.g., host cell proteins). Affinity chromatography, high performance liquid chromatography (HPLC), and size exclusion chromatography (SEC) are examples of methods that can be used to improve the purity of the expressed protein.

Other methods can also be used to produce polypeptides or fragments thereof. For example, two or more peptides or polypeptides can be linked together by protein chemistry techniques. For example, peptides or polypeptides can be chemically synthesized using either Fmoc (9-fluorenylmethyloxycarbonyl) or Boc (tert-butyloxycarbonoyl) chemistry. Such peptides or polypeptides can be synthesized by standard chemical reactions. For example, a peptide or polypeptide can be synthesized and not cleaved from its synthesis resin, whereas the other fragment of a peptide or protein can be synthesized and subsequently cleaved from the resin, thereby exposing a terminal group which is functionally blocked on the other fragment. By peptide condensation reactions, these two fragments can be covalently joined via a peptide bond at their carboxyl and amino termini, respectively. Alternately, the peptide or polypeptide can be independently synthesized in vivo as described herein. Once isolated, these independent peptides or polypeptides may be linked to form a peptide or fragment thereof via similar peptide condensation reactions.

In some embodiments, enzymatic ligation of cloned or synthetic peptide segments allow relatively short peptide fragments to be joined to produce larger peptide fragments, polypeptides, or whole protein domains (Abrahmsen et al., *Biochemistry,* 1991, 30, 4151). Alternately, native chemical ligation of synthetic peptides can be utilized to synthetically construct large peptides or polypeptides from shorter peptide fragments. This method can consist of a two-step chemical reaction (Dawson et al., *Science,* 1994, 266, 776-779). The first step can be the chemoselective reaction of an unprotected synthetic peptide-thioester with another unprotected peptide segment containing an amino-terminal Cys residue to give a thioester-linked intermediate as the initial covalent product. Without a change in the reaction conditions, this intermediate can undergo spontaneous, rapid intramolecular reaction to form a native peptide bond at the ligation site.

In some embodiments, unprotected peptide segments can be chemically linked where the bond formed between the peptide segments as a result of the chemical ligation is an unnatural (non-peptide) bond (Schnolzer et al., *Science,* 1992, 256, 221).

In some embodiments, the polypeptides can possess post-expression modifications such as, for example, glycosylations, acetylations, and phosphorylations, as well as other modifications known in the art, both naturally occurring and non-naturally occurring. A polypeptide may be an entire protein, or a subsequence thereof.

The present disclosure also provides methods of producing any of the polypeptides disclosed herein, comprising culturing a host cell comprising a recombinant expression vectors comprising nucleic acid molecules comprising a polynucleotide capable of encoding one or more of the polypeptides disclosed herein, or its complement, thereby producing the polypeptide.

The present disclosure also provides cells (e.g., recombinant host cells) comprising any one or more of the nucleic acid molecules, including vectors comprising the nucleic acid molecules, and/or any one or more of the polypeptides disclosed herein. The cells can be in vitro, ex vivo, or in vivo. Nucleic acid molecules can be linked to a promoter and other regulatory sequences so they are expressed to produce an encoded protein. Cell lines of such cells are further provided.

In some embodiments, the cell is a totipotent cell or a pluripotent cell (e.g., an embryonic stem (ES) cell such as a rodent ES cell, a mouse ES cell, or a rat ES cell). Totipotent cells include undifferentiated cells that can give rise to any cell type, and pluripotent cells include undifferentiated cells that possess the ability to develop into more than one differentiated cell types. Such pluripotent and/or totipotent cells can be, for example, ES cells or ES-like cells, such as an induced pluripotent stem (iPS) cells. ES cells include embryo-derived totipotent or pluripotent cells that are capable of contributing to any tissue of the developing embryo upon introduction into an embryo. ES cells can be derived from the inner cell mass of a blastocyst and are capable of differentiating into cells of any of the three vertebrate germ layers (endoderm, ectoderm, and mesoderm). In accordance with the present disclosure, the embryonic stem cells may be non-human embryonic stem cells.

In some embodiments, the cell is a primary somatic cell, or a cell that is not a primary somatic cell. Somatic cells can include any cell that is not a gamete, germ cell, gametocyte, or undifferentiated stem cell. In some embodiments, the cell can also be a primary cell. Primary cells include cells or cultures of cells that have been isolated directly from an organism, organ, or tissue. Primary cells include cells that are neither transformed nor immortal. Primary cells include any cell obtained from an organism, organ, or tissue which was not previously passed in tissue culture or has been previously passed in tissue culture but is incapable of being indefinitely passed in tissue culture. Such cells can be isolated by conventional techniques and include, for example, somatic cells, hematopoietic cells, endothelial cells, epithelial cells, fibroblasts, mesenchymal cells, keratinocytes, melanocytes, monocytes, mononuclear cells, adipocytes, preadipocytes, neurons, glial cells, hepatocytes, skeletal myoblasts, and smooth muscle cells. For example, primary cells can be derived from connective tissues, muscle tissues, nervous system tissues, or epithelial tissues.

In some embodiments, the cells may normally not proliferate indefinitely but, due to mutation or alteration, have evaded normal cellular senescence and instead can keep undergoing division. Such mutations or alterations can occur naturally or be intentionally induced. Examples of immortalized cells include, but are not limited to, Chinese hamster ovary (CHO) cells, human embryonic kidney cells (e.g., HEK 293 cells), and mouse embryonic fibroblast cells (e.g., 3T3 cells). Numerous types of immortalized cells are well known. Immortalized or primary cells include cells that are typically used for culturing or for expressing recombinant genes or proteins. In some embodiments, the cell is a differentiated cell, such as a liver cell (e.g., a human liver cell).

The cell can be from any source. For example, the cell can be a eukaryotic cell, an animal cell, a plant cell, or a fungal (e.g., yeast) cell. Such cells can be fish cells or bird cells, or such cells can be mammalian cells, such as human cells, non-human mammalian cells, rodent cells, mouse cells or rat cells. Mammals include, but are not limited to, humans, non-human primates, monkeys, apes, cats dogs, horses, bulls, deer, bison, sheep, rodents (e.g., mice, rats, hamsters, guinea pigs), livestock (e.g., bovine species such as cows, steer, etc.; ovine species such as sheep, goats, etc.; and porcine species such as pigs and boars). Birds include, but are not limited to, chickens, turkeys, ostrich, geese, ducks, etc. Domesticated animals and agricultural animals are also included. The term "non-human animal" excludes humans.

Additional host cells are described in, for example, U.S. Provisional Application No. 62/367,973, filed on Jul. 28, 2016, which is incorporated herein by reference in its entirety.

The nucleic acid molecules and polypeptides disclosed herein can be introduced into a cell by any means. Transfection protocols as well as protocols for introducing nucleic acids or proteins into cells may vary. Non-limiting transfection methods include chemical-based transfection methods using liposomes, nanoparticles, calcium, dendrimers, and cationic polymers such as DEAE-dextran or polyethylenimine. Non-chemical methods include electroporation, sono-poration, and optical transfection. Particle-based transfection includes the use of a gene gun, or magnet-assisted transfection. Viral methods can also be used for transfection.

Introduction of nucleic acids or proteins into a cell can also be mediated by electroporation, by intracytoplasmic injection, by viral infection, by adenovirus, by adeno-associated virus, by lentivirus, by retrovirus, by transfection, by lipid-mediated transfection, or by nucleofection. Nucleofection is an improved electroporation technology that enables nucleic acid substrates to be delivered not only to the cytoplasm but also through the nuclear membrane and into the nucleus. In addition, use of nucleofection in the methods disclosed herein typically requires much fewer cells than regular electroporation (e.g., only about 2 million compared with 7 million by regular electroporation). In some embodiments, nucleofection is performed using the LONZA® NUCLEOFECTOR™ system.

Introduction of nucleic acids or proteins into a cell can also be accomplished by microinjection. Microinjection of an mRNA is usually into the cytoplasm (e.g., to deliver mRNA directly to the translation machinery), while microinjection of a protein or a DNA is usually into the nucleus. Alternately, microinjection can be carried out by injection into both the nucleus and the cytoplasm: a needle can first be introduced into the nucleus and a first amount can be injected, and while removing the needle from the cell a second amount can be injected into the cytoplasm. If a nuclease agent protein is injected into the cytoplasm, the protein may comprise a nuclear localization signal to ensure delivery to the nucleus/pronucleus.

Other methods for introducing nucleic acid or proteins into a cell can include, for example, vector delivery, particle-mediated delivery, exosome-mediated delivery, lipid-nanoparticle-mediated delivery, cell-penetrating-peptide-mediated delivery, or implantable-device-mediated delivery. Methods of administering nucleic acids or proteins to a subject to modify cells in vivo are disclosed elsewhere herein. Introduction of nucleic acids and proteins into cells can also be accomplished by hydrodynamic delivery (HDD).

Other methods for introducing nucleic acid or proteins into a cell can include, for example, vector delivery, particle-mediated delivery, exosome-mediated delivery, lipid-nanoparticle-mediated delivery, cell-penetrating-peptide-mediated delivery, or implantable-device-mediated delivery. In some embodiments, a nucleic acid or protein can be introduced into a cell in a carrier such as a poly(lactic acid) (PLA) microsphere, a poly(D,L-lactic-coglycolic-acid) (PLGA) microsphere, a liposome, a micelle, an inverse micelle, a lipid cochleate, or a lipid microtubule.

The present disclosure also provides probes and primers. Examples of probes and primers are disclosed above for example. The present disclosure provides probes and primers comprising a nucleic acid sequence that specifically hybridizes to any of the nucleic acid molecules disclosed herein. For example, the probe or primer may comprise a nucleic acid sequence which hybridizes to a nucleic acid molecule encoding a GPR156 protein comprising an aspartic acid at the position corresponding to position at 533 according to SEQ ID NO:4, or which hybridizes to the complement of this nucleic acid molecule. In some embodiments, the probe or primer of the disclosure comprises a nucleic acid sequence which hybridizes to a nucleic acid molecule encoding a GPR156 protein according to SEQ ID NO:4, or which hybridizes to the complement of this nucleic acid molecule. In some embodiments, the probe or primer may comprise a nucleic acid sequence which hybridizes to a nucleic acid molecule encoding a GPR156 protein comprising an aspartic acid at the position corresponding to position at 529 according to SEQ ID NO:5, or which hybridizes to the complement of this nucleic acid molecule. In some embodiments, the probe or primer comprises a nucleic acid sequence which hybridizes to a nucleic acid molecule encoding a GPR156 protein according to SEQ ID NO:5, or which hybridizes to the complement of this nucleic acid molecule. The probe or primer may comprise any suitable length, non-limiting examples of which include at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides in length. In preferred embodiments, the probe or primer comprises at least about 18 nucleotides in length. The probe or primer may comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides in length. In preferred embodiments, the probe or primer is from about 18 to about 30 nucleotides in length.

The present disclosure also provides allele-specific probes and allele-specific primers. The allele-specific probe or primer of the disclosure specifically hybridizes to a nucleic acid sequence encoding a GPR156 protein comprising an aspartic acid at the position corresponding to position 533 according to SEQ ID NO:4, or to the complement thereof.

In the context of the disclosure "specifically hybridizes" means that the probe or primer (e.g. the allele-specific probe or primer) does not hybridize to a nucleic acid sequence encoding a GPR156 protein which does not comprise an aspartic acid at the position corresponding to position 533 according to SEQ ID NO:4. A probe or primer according to the disclosure preferably encompasses the nucleic acid codon which encodes the E533D variation n within a GPR156 protein, or the complement thereof.

Thus, the present disclosure provides an allele-specific probe or primer comprising a nucleic acid sequence which is complementary to a nucleic acid sequence encoding a GPR156 protein, wherein the allele-specific probe or primer comprises a nucleic acid sequence which is complementary to the nucleic acid codon encoding an aspartic acid at the position corresponding to position 533 according to SEQ ID NO:4.

Accordingly, an allele-specific probe or primer according to the disclosure comprises a nucleic acid sequence which is complementary to a nucleic acid sequence encoding the GPR156 protein comprising an aspartic acid at position 533 according to SEQ ID NO:4. The allele-specific probe or primer according to the disclosure may be used to detect the E533D variation within GPR156 and/or the E529D mutation within the shorter isoform of GPR156. For example, the allele-specific primer according to the disclosure may be used to amplify the nucleic acid sequence encoding GPR156 (e.g., having the amino acid sequence of SEQ ID NO:4) or a fragment thereof comprising the E533D variation. An allele-specific primer according to the disclosure may also be used to amplify the nucleic acid sequence of a GPR156 isoform (such as the isoform having the amino acid sequence of SEQ ID NO: 5) or a fragment thereof comprising the E529D mutation.

In some embodiments, the allele-specific probe or primer of the disclosure comprises a nucleic acid sequence which is complementary to a nucleic acid sequence encoding a GPR156 protein according to SEQ ID NO:4. In some embodiments, the allele-specific probe or primer comprises a nucleic acid sequence which is complementary to a nucleic acid sequence encoding a GPR156 protein according to SEQ ID NO:5. In some embodiments, the allele-specific probe or primer comprises a nucleic acid sequence which is complementary to a nucleic acid sequence encoding a GPR156 protein comprising an aspartic acid at the position corresponding to position 533 according to SEQ ID NO:4, or to position 529 according to SEQ ID NO:5. In some embodiments, the allele-specific primer specifically hybridizes to any of the nucleic acid molecules disclosed herein, wherein the aspartic acid is encoded by the codon GAT or GAU. In some embodiments, the allele-specific primer specifically hybridizes to any of the nucleic acid molecules disclosed herein, wherein the aspartic acid is encoded by the codon GAC. The aspartic acid-encoding codon may be at the 3' end of the allele-specific primer.

In preferred embodiments, the allele-specific probe or primer binds to the major allele of the GPR156 gene. Thus, the allele-specific primer preferably binds to the major allele of the GPR156 gene and not to the minor allele of the GPR156 gene. The major allele comprises a nucleic acid sequence encoding an aspartic acid at a position corresponding to position 516 of SEQ ID NO:4, though the wild-type major allele comprises a nucleic acid sequence encoding a glutamic acid at a position corresponding to position 533 of SEQ ID NO:4. The minor allele comprises a nucleic acid sequence encoding a glutamic acid at a position corresponding to position 516 of SEQ ID NO:4, though the minor allele comprises a nucleic acid sequence encoding aspartic acid at a position corresponding to position 533 of SEQ ID NO:4. Accordingly, the allele-specific probe or primer may specifically hybridize to the minor allele of the GRP156 gene comprising the E533D variation. According to the disclosure, the allele-specific probe or primer does not hybridize to the major allele which does not comprise the E533D variation.

The length which is described above with regard to the probe or primer of the disclosure applies, mutatis mutandis, also for the allele-specific probe or primer of the disclosure.

The disclosure also provides a pair of allele-specific primers comprising one of the allele-specific primers as described above.

In some embodiments, the probe or primer (e.g. the allele-specific probe or primer) comprises DNA. In some embodiments, the probe or primer (e.g. the allele-specific probe or primer) comprises RNA. In some embodiments, the probe (e.g. the allele-specific probe) hybridizes to any of the nucleic acid molecules disclosed herein wherein the aspartic acid (at the position corresponding to position 533 according to SEQ ID NO:4) is encoded by the codon GAT (or GAU). In some embodiments, the probe hybridizes to any of the nucleic acid molecules disclosed herein wherein the aspartic acid (at the position corresponding to position 533 according to SEQ ID NO:4) is encoded by the codon GAC. In some embodiments, the probe (e.g. the allele-specific probe) hybridizes to the nucleic acid sequence encoding the human GPR156 protein under stringent conditions, such as high stringent conditions.

In some embodiments, the probe comprises a label. In some embodiments, the label is a fluorescent label, a radiolabel, or biotin. In some embodiments, the length of the probe is described above. Alternately, in some embodiments, the probe comprises or consists of at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 nucleotides. The probe (e.g., the allele-specific probe) may be used, for example, to detect any of the nucleic acid molecules disclosed herein. In preferred embodiments, the probe comprises at least about 18 nucleotides in length. The probe may comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides in length. In preferred embodiments, the probe is from about 18 to about 30 nucleotides in length.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern.

Solid-state substrates for use in solid supports can include any solid material to which molecules can be coupled. This includes materials such as acrylamide, agarose, cellulose, nitrocellulose, glass, polystyrene, polyethylene vinyl acetate, polypropylene, polymethacrylate, polyethylene, polyethylene oxide, polysilicates, polycarbonates, teflon, fluorocarbons, nylon, silicon rubber, polyanhydrides, polyglycolic acid, polylactic acid, polyorthoesters, polypropylfumerate, collagen, glycosaminoglycans, and polyamino acids. Solid-state substrates can have any useful form including thin film, membrane, bottles, dishes, fibers, woven fibers, shaped polymers, particles, beads, microparticles, or a combination. Solid-state substrates and solid supports can be porous or non-porous. A form for a solid-state substrate is a microtiter dish, such as a standard 96-well type. In some embodiments, a multiwell glass slide can be employed that normally contain one array per well. This feature allows for greater control of assay reproducibility, increased throughput and sample handling, and ease of automation. In some embodiments, the support is a microarray.

Any of the polypeptides disclosed herein can further have one or more substitutions (such as conservative amino acid substitutions), insertions, or deletions that are in addition to the aspartic acid at position 533 or 529 as described herein. Insertions include, for example, amino or carboxyl terminal fusions as well as intrasequence insertions of single or multiple amino acid residues. Techniques for making substitutions at predetermined sites in DNA having a known sequence are well known, for example M13 primer mutagenesis and PCR mutagenesis. Amino acid substitutions are typically of single residues, but can occur at a number of different locations at once; insertions usually will be on the order of about from 1 to 10 amino acid residues; and deletions will range about from 1 to 30 residues. Deletions or insertions can be made in adjacent pairs, i.e. a deletion of 2 residues or insertion of 2 residues. Substitutions, deletions, insertions or any combination thereof may be combined to arrive at a final construct. In some embodiments, the mutations do not place the sequence out of reading frame and do not create complementary regions that could produce secondary mRNA structure.

The present disclosure also provides kits for making the compositions and utilizing the methods described herein. The kits described herein can comprise an assay or assays for detecting one or more genetic variants in a sample of a subject.

In some embodiments, the kits for human identification of GPR156 variants utilize the compositions and methods described above. In some embodiments, a basic kit can comprise a container having at least one pair of oligonucleotide primers for a locus in any of the nucleic acid molecules disclosed herein (such as, for example, SEQ ID NOs:9 to 12, SEQ ID NOs:16 to 21, or SEQ ID NOs:25 to 30). A kit can also optionally comprise instructions for use. A kit can also comprise other optional kit components, such as, for example, one or more of an allelic ladder directed to each of the loci amplified, a sufficient quantity of enzyme for amplification, amplification buffer to facilitate the amplification, divalent cation solution to facilitate enzyme activity, dNTPs for strand extension during amplification, loading solution for preparation of the amplified material for electrophoresis, genomic DNA as a template control, a size marker to insure that materials migrate as anticipated in the separation medium, and a protocol and manual to educate the user and limit error in use. The amounts of the various reagents in the kits also can be varied depending upon a number of factors, such as the optimum sensitivity of the process. It is within the scope of these teachings to provide test kits for use in manual applications or test kits for use with automated sample preparation, reaction set-up, detectors or analyzers.

In some embodiments, the kits comprise at least one pair of oligonucleotide primers for amplification of at least one locus encoding the aspartic acid, wherein one primer of the pair hybridizes to a SNP nucleobase within a primer binding site of the at least one locus and at least one primer of the pair comprises a fluorescent label. In some aspects, the locus comprises a variant in the GPR156 gene.

In some embodiments, the kit comprises at least one pair of oligonucleotide primers for PCR amplification of at least one locus selected from any of the nucleic acid molecules disclosed herein (such as, for example, SEQ ID NOs:9 to 12, SEQ ID NOs:16 to 21, or SEQ ID NOs:25 to 30), wherein one primer of the pair hybridizes to a SNP nucleobase within a primer binding site of the at least one locus. In some embodiments, the kit further comprises an allelic ladder corresponding to the at least one locus selected from any of the nucleic acid molecules disclosed herein (such as, for example, SEQ ID NOs:9 to 12, SEQ ID NOs:16 to 21, or SEQ ID NOs:25 to 30), at least one of a protocol, an enzyme, dNTPs, a buffer, a salt or salts, and a control nucleic acid sample. In some embodiments, the SNP nucleobase is within a sequence selected from any of the nucleic acid molecules disclosed herein (such as, for example, SEQ ID NOs:9 to 12, SEQ ID NOs:16 to 21, or SEQ ID NOs:25 to 30).

In some aspects, the kits disclosed herein can comprise a primer comprising a 3' terminal nucleotide that hybridizes directly to a thymine or uracil at nucleotide position 1599 of any of the cDNA or mRNA molecules disclosed herein (such as, for example, SEQ ID NOs:16 to 21, or SEQ ID NOs:25 to 30).

Also disclosed herein are kits comprising: at least one nucleic acid probe designed to detect a nucleotide variance in any of the nucleic acid molecules disclosed herein at a position encoding an aspartic acid at the position corresponding to position 533 of SEQ ID NO:4, wherein detection is based on specific hybridization to the nucleotide variance sequence, wherein the nucleic acid probe comprises a detectable label, products and reagents required to carry out an annealing reaction; and instructions. The kit may comprise any of the probes described herein.

Disclosed herein are kits comprising: at least one pair of oligonucleotide primers for amplification of at least one locus of any of the nucleic acid molecules disclosed herein at a position encoding an aspartic acid at the position corresponding to position 533 of SEQ ID NO:4, wherein one primer of the pair hybridizes to a SNP nucleobase within a primer binding site of the at least one locus and at least one primer of the pair comprises a fluorescent label. The kit may comprise any of the primers described herein.

Disclosed herein are kits comprising at least one pair of oligonucleotide primers for amplification of at least one locus of any of the nucleic acid molecules disclosed herein at a position encoding an aspartic acid at the position corresponding to position 533 of SEQ ID NO:4, wherein one primer of the pair hybridizes to a SNP nucleobase within a primer binding site of the at least one locus and at least one primer of the pair comprises a fluorescent label further comprising an allelic ladder corresponding to the at least one locus of any of the nucleic acid molecules disclosed herein at a position encoding an aspartic acid corresponding to position 533 of SEQ ID NO:4. The kit may comprise any of the primers described herein.

Disclosed herein are kits comprising at least one pair of oligonucleotide primers for amplification of at least one locus of any of the nucleic acid molecules disclosed herein at a position encoding an aspartic acid corresponding to position 533 of SEQ ID NO:4, wherein one primer of the pair hybridizes to a SNP nucleobase within a primer binding site of the at least one locus and at least one primer of the pair comprises a fluorescent label, wherein the primers are used in a polymerase chain reaction (PCR). The kit may comprise any of the primers described herein.

Disclosed herein are kits comprising at least one pair of oligonucleotide primers for amplification of at least one locus of any of the nucleic acid molecules disclosed herein at a position encoding an aspartic acid at the position corresponding to position 533 of SEQ ID NO:4, wherein one primer of the pair hybridizes to a SNP nucleobase within a primer binding site of the at least one locus and at least one primer of the pair comprises a fluorescent label, further comprising at least one of a protocol, an enzyme, dNTPs, a buffer, a salt or salts, and a control nucleic acid sample. The kit may comprise any of the primers described herein.

TABLE 1

| Primers | | | |
|---|---|---|---|
| Forward Primer (5'→3') | SEQ ID NO: | Reverse Primer (5'→3') | SEQ ID NO |
| TCTCCCCAG | 31 | | |
| AGAGGGGTC | 32 | | |
| TCTCCCCAT | 33 | | |
| AGAGGGGA | 34 | | |
| CCAGAGTCTCC TACCAGATAG | 35 | AGAAGGCTGGC GAAGAAAGG | 36 |
| CAACGCCAAAG AGAAGATTG | 37 | CTTCCAGGTTT GCTGATGACA | 38 |
| AAGATATCTGA CTCAAAAGAC | 39 | AGAGCCAGGAA AGTGTGAGC | 40 |
| TTTCAGAATGA TCCTGGCATG | 41 | ACTGTTCTTCC AGGTTTGCTG | 42 |

Those in the art understand that the detection techniques employed are generally not limiting. Rather, a wide variety of detection means are within the scope of the disclosed methods and kits, provided that they allow the presence or absence of an amplicon to be determined.

In some aspects, a kit can comprise one or more of the primers or probes disclosed herein. For example, a kit can comprise one or more probes that hybridize to one or more of the disclosed genetic variants.

In some aspects, a kit can comprise one of the disclosed cells or cell lines. In some aspects, a kit can comprise the materials necessary to create a transgenic cell or cell line. For example, in some aspects a kit can comprise a cell and a vector comprising a nucleic acid sequence comprising one or more of the disclosed genetic variants. A kit can further comprise media for cell culture.

The present disclosure also provides methods for detecting the presence of a GPR156 variant gene, mRNA, cDNA, and/or polypeptide in a biological sample from a subject human. It is understood that gene sequences within a population and mRNAs and proteins encoded by such genes can vary due to polymorphisms such as single-nucleotide polymorphisms. The sequences provided herein for the GPR156 gene, mRNA, cDNA, and polypeptide are only exemplary sequences. Other sequences for the GPR156 gene, mRNA, cDNA, and polypeptide are also possible.

The biological sample can be derived from any cell, tissue, or biological fluid from the subject. The sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The sample used in the methods disclosed herein will vary based on the assay format, nature of the detection method, and the tissues, cells, or extracts that are used as the sample. A biological sample can be processed differently depending on the assay being employed. For example, when detecting a variant GPR156 nucleic acid molecule, preliminary processing designed to isolate or enrich the sample for the genomic DNA can be employed. A variety of known techniques may be used for this purpose. When detecting the level of variant GPR156 mRNA, different techniques can be used enrich the biological sample with mRNA. Various methods to detect the presence or level of a mRNA or the presence of a particular variant genomic DNA locus can be used.

In some embodiments, the disclosure provides methods of detecting the presence or absence of a variant GPR156 nucleic acid molecule comprising sequencing at least a portion of a nucleic acid in a biological sample to determine whether the nucleic acid comprises a nucleic acid sequence encoding an aspartic acid at the position corresponding to position 533 according to SEQ ID NO:4 or at the position corresponding to position 529 according to SEQ ID NO:5. Any of the variant nucleic acid molecules disclosed herein can be detected using any of the probes described herein.

In some embodiments, the methods of detecting the presence or absence of a unipolar depression-associated variant GPR156 nucleic acid molecule (e.g., gene, mRNA, or cDNA) in a subject, comprising: performing an assay on a biological sample obtained from the subject, which assay determines whether a nucleic acid molecule in the biological sample comprises a nucleic acid sequence that encodes an aspartic acid at the position corresponding to position 533 according to SEQ ID NO:4 or at the position corresponding to position 529 according to SEQ ID NO:5. In some embodiments, the biological sample comprises a cell or cell lysate. Such methods can further comprise, for example, obtaining a biological sample from the subject comprising a GPR156 gene or mRNA, and if mRNA, optionally reverse transcribing the mRNA into cDNA, and performing an assay on the biological sample that determines that a position of the GPR156 gene, mRNA, or cDNA encodes an aspartic acid at the position corresponding to position 533 of the variant GPR156 polypeptide. Such assays can comprise, for example determining the identity of these positions of the particular GPR156 nucleic acid molecule. In some embodiments, the subject is a human.

In some embodiments, the methods of detecting the presence or absence of an anxiety disorder-associated variant GPR156 nucleic acid molecule (e.g., gene, mRNA, or cDNA) in a subject, comprising: performing an assay on a biological sample obtained from the subject, which assay determines whether a nucleic acid molecule in the biological sample comprises a nucleic acid sequence that encodes an aspartic acid at the position corresponding to position 533 according to SEQ ID NO:4 or at the position corresponding to position 529 according to SEQ ID NO:5. In some embodiments, the biological sample comprises a cell or cell lysate. Such methods can further comprise, for example, obtaining a biological sample from the subject comprising a GPR156 gene or mRNA, and if mRNA, optionally reverse transcribing the mRNA into cDNA, and performing an assay on the biological sample that determines that a position of the GPR156 gene, mRNA, or cDNA encodes an aspartic acid at the position corresponding to position 533 of the variant GPR156 polypeptide. Such assays can comprise, for example determining the identity of these positions of the particular GPR156 nucleic acid molecule. In some embodiments, the subject is a human.

In some embodiments, the assay comprises: sequencing at least a portion of the GPR156 genomic sequence of a nucleic acid molecule in the biological sample from the subject, wherein the portion sequenced includes the position corresponding to the position encoding an aspartic acid at position 533 in the GPR156 protein according to SEQ ID NO:4, or at the position corresponding to position 529 according to SEQ ID NO:5; sequencing a portion of the GPR156 mRNA sequence of a nucleic acid molecule in the biological sample from the subject, wherein the portion sequenced includes the position corresponding to the position encoding an aspartic acid at position 533 in the GPR156 protein according to SEQ ID NO:4, or at the position corresponding to position 529 according to SEQ ID NO:5; or sequencing a portion of the GPR156 cDNA sequence of a nucleic acid molecule obtained from mRNA obtained from the biological sample obtained from the subject, wherein the portion sequenced includes the position corresponding to the position encoding an aspartic acid at position 533 in the GPR156 protein according to SEQ ID NO:4, or at the position corresponding to position 529 according to SEQ ID NO:5.

In some embodiments, the assay comprises: a) contacting the biological sample with a primer hybridizing to: i) a portion of the GPR156 genomic sequence that is proximate to a position of the GPR156 genomic sequence at the position corresponding to the position encoding an aspartic acid at position 533 according to SEQ ID NO:4, or at the position corresponding to position 529 according to SEQ ID NO:5; ii) a portion of the GPR156 mRNA sequence that is proximate to a position of the GPR156 mRNA corresponding to the position encoding an aspartic acid at position 533 according to SEQ ID NO:4, or at the position corresponding to position 529 according to SEQ ID NO:5; or iii) a portion of the GPR156 cDNA sequence that is proximate to a position of the GPR156 cDNA corresponding to the position encoding an aspartic acid at position 533 according to SEQ ID NO:4, or at the position corresponding to position 529 according to SEQ ID NO:5; b) extending the primer at least through: i) the position of the GPR156 genomic sequence corresponding to nucleotide positions beyond the codon encoding an aspartic acid at position 533 according to SEQ ID NO:4 or at the position corresponding to position 529 according to SEQ ID NO:5; ii) the position of the GPR156 mRNA corresponding to nucleotide positions beyond the codon encoding an aspartic acid at the position corresponding to position 533 according to SEQ ID NO:4, or at the position corresponding to position 529 according to SEQ ID NO:5; or iii) the position of the GPR156 cDNA corresponding to nucleotide positions beyond the codon encoding an aspartic acid at the position corresponding to position 533 according to SEQ ID NO:4, or at the position corresponding to position 529 according to SEQ ID NO:5; and c) determining whether the extension product of the primer comprises nucleotides encoding an aspartic acid at the position corresponding to position 533 according to SEQ ID NO:4, or at the position corresponding to position 529 according to SEQ ID NO:5. In some embodiments, only GPR156 genomic DNA is analyzed. In some embodiments, only GPR156 mRNA is analyzed. In some embodiments, only GPR156 cDNA obtained from GPR156 mRNA is analyzed.

In some embodiments, the assay comprises: a) contacting the biological sample with an allele-specific primer hybridizing to i) a portion of the GPR156 genomic sequence including the nucleotides encoding an amino acid at the position corresponding to position 533 according to SEQ ID NO:4, or at the position corresponding to position 529 according to SEQ ID NO:5; ii) a portion of the GPR156 mRNA sequence including the nucleotides encoding an amino acid at the position corresponding to position 533 according to SEQ ID NO:4, or at the position corresponding to position 529 according to SEQ ID NO:5; or iii) a portion of the GPR156 cDNA sequence including the nucleotides encoding an amino acid at the position corresponding to position 533 according to SEQ ID NO:4, or at the position corresponding to position 529 according to SEQ ID NO:5; b) extending the primer using an allele-specific polymerase chain reaction technique; and c) determining whether extension occurred. Allele-specific polymerase chain reaction techniques can be used to detect mutations such as SNPs in a nucleic acid sequence. Allele-specific primers are used because the DNA polymerase will not extend when a mismatch with the template is present. A number of variations of the basic allele-specific polymerase chain reaction technique are at the disposal of the skilled artisan.

The allele-specific primer may comprise a nucleic acid sequence which is complementary to a nucleic acid sequence encoding the GPR156 protein comprising an aspartic acid at the position corresponding to position 533 according to SEQ ID NO:4, or at the position corresponding to position 529 according to SEQ ID NO:5, or the complement to the nucleic acid sequence. For example, the allele-specific primer may comprise a nucleic acid sequence which is complementary to the nucleic acid sequence encoding SEQ ID NO:4 and/or SEQ ID NO:5, or to the complement to this nucleic acid sequence. The allele-specific primer preferably specifically hybridizes to the nucleic acid sequence encoding the GPR156 protein when the nucleic acid sequence encodes an aspartic acid at the position corresponding to position 533 according to SEQ ID NO:4, or at the position corresponding to position 529 according to SEQ ID NO:5 via the codon GAT (or GAU) or GAC.

In some embodiments, the assay comprises contacting the biological sample with a primer or probe that specifically hybridizes to a variant GPR156 genomic sequence, mRNA sequence, or cDNA sequence and not the corresponding wild type GPR156 sequence under stringent conditions, and determining whether hybridization has occurred.

In some embodiments, the assay comprises RNA sequencing (RNA-Seq). In some embodiments, the assays also comprise reverse transcribing mRNA into cDNA via the reverse transcriptase polymerase chain reaction (RT-PCR).

In some embodiments, the methods utilize probes and primers of sufficient nucleotide length to bind to the target nucleic acid sequence and specifically detect and/or identify a polynucleotide comprising a variant GPR156 gene, mRNA, or cDNA. The hybridization conditions or reaction conditions can be determined by the operator to achieve this result. This nucleotide length may be any length that is sufficient for use in a detection method of choice, including any assay described or exemplified herein. Generally, for example, primers or probes having about 8, about 10, about 11, about 12, about 14, about 15, about 16, about 18, about 20, about 22, about 24, about 26, about 28, about 30, about 40, about 50, about 75, about 100, about 200, about 300, about 400, about 500, about 600, or about 700 nucleotides, or more, or from about 11 to about 20, from about 20 to about 30, from about 30 to about 40, from about 40 to about 50, from about 50 to about 100, from about 100 to about 200, from about 200 to about 300, from about 300 to about 400, from about 400 to about 500, from about 500 to about 600, from about 600 to about 700, or from about 700 to about 800, or more nucleotides in length are used. In preferred embodiments, the probe or primer comprises at least about 18 nucleotides in length. The probe or primer may comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides in length. In preferred embodiments, the probe or primer is from about 18 to about 30 nucleotides in length.

Such probes and primers can hybridize specifically to a target sequence under high stringency hybridization conditions. Probes and primers may have complete nucleic acid sequence identity of contiguous nucleotides with the target sequence, although probes differing from the target nucleic acid sequence and that retain the ability to specifically detect and/or identify a target nucleic acid sequence may be designed by conventional methods. Accordingly, probes and primers can share about 80%, about 85%, about 90%, about 91%, about 92%, about 93%, about 94%, about 95%, about 96%, about 97%, about 98%, about 99%, or 100% sequence identity or complementarity to the target nucleic acid molecule.

In some embodiments, specific primers can be used to amplify the variant GPR156 locus and/or GPR156 variant mRNA or cDNA to produce an amplicon that can be used as a specific probe or can itself be detected for identifying the variant GPR156 locus or for determining the level of specific GPR156 mRNA or cDNA in a biological sample. The GPR156 variant locus can be used to denote a genomic nucleic acid sequence including positions corresponding to positions encoding an aspartic acid at position 533 according to SEQ ID NO:4 or at position 529 according to SEQ ID NO:5. When the probe is hybridized with a nucleic acid molecule in a biological sample under conditions that allow for the binding of the probe to the nucleic acid molecule, this binding can be detected and allow for an indication of the presence of the variant GPR156 locus or the presence or the level of variant GPR156 mRNA or cDNA in the biological sample. Such identification of a bound probe has been described. The specific probe may comprise a sequence of at least about 80%, from about 80% to about 85%, from about 85% to about 90%, from about 90% to about 95%, and from about 95% to about 100% identical (or complementary) to a specific region of a variant GPR156 gene. The specific probe may comprise a sequence of at least about 80%, from about 80% to about 85%, from about 85% to about 90%, from about 90% to about 95%, and from about 95% to about 100% identical (or complementary) to a specific region of a variant GPR156 mRNA. The specific probe may comprise a sequence of at least about 80%, from about 80% to about 85%, from about 85% to about 90%, from about 90% to about 95%, and from about 95% to about 100% identical (or complementary) to a specific region of a variant GPR156 cDNA.

In some embodiments, to determine whether the nucleic acid complement of a biological sample comprises a nucleic acid sequence encoding the aspartic acid at the position corresponding to position 533 according to SEQ ID NO:4, or at the position corresponding to position 529 according to SEQ ID NO:5, the biological sample may be subjected to a nucleic acid amplification method using a primer pair that includes a first primer derived from the 5' flanking sequence adjacent to positions encoding the aspartic acid at the position corresponding to position 533 according to SEQ ID NO:4, or at the position corresponding to position 529 according to SEQ ID NO:5 and a second primer derived from the 3' flanking sequence adjacent to positions encoding the aspartic acid at the position corresponding to position 533 according to SEQ ID NO:4, or at the position corresponding to position 529 according to SEQ ID NO:5 to produce an amplicon that is diagnostic for the presence of the SNP at positions encoding the aspartic acid at the position corresponding to position 533 according to SEQ ID NO:4, or at the position corresponding to position 529 according to SEQ ID NO:5. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions encoding the aspartic acid at position 533 according to SEQ ID NO:4 or at position 529 according to SEQ ID NO:5 and at least 1, 2, 3, 4, 5, 6, 7, 8, 9, 10, or more nucleotides on each side of positions encoding the aspartic acid at position 533 according to SEQ ID NO:4 or at position 529 according to SEQ ID NO:5. Similar amplicons can be generated from the mRNA and/or cDNA sequences.

Representative methods for preparing and using probes and primers are described, for example, in *Molecular Cloning: A Laboratory Manual,* 2nd Ed., Vol. 1-3, ed. Sambrook et al., Cold Spring Harbor Laboratory Press, Cold Spring Harbor, N.Y. 1989 (hereinafter, "Sambrook et al., 1989"); *Current Protocols in Molecular Biology*, ed. Ausubel et al., Greene Publishing and Wiley-Interscience, New York, 1992 (with periodic updates) (hereinafter, "Ausubel et al., 1992"); and Innis et al., PCR Protocols: A Guide to Methods and Applications, Academic Press: San Diego, 1990). PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT, 1991, Whitehead Institute for Biomedical Research, Cambridge, Mass.). Additionally, the sequence can be visually scanned and primers manually identified using known guidelines.

Any nucleic acid hybridization or amplification or sequencing method can be used to specifically detect the presence of the variant GPR156 gene locus and/or the level of variant GPR156 mRNA or cDNA produced from mRNA. In some embodiments, the nucleic acid molecule can be used either as a primer to amplify a region of the GPR156 nucleic acid or the nucleic acid molecule can be used as a probe that specifically hybridizes, for example, under stringent conditions, to a nucleic acid molecule comprising the variant GPR156 gene locus or a nucleic acid molecule comprising a variant GPR156 mRNA or cDNA produced from mRNA.

A variety of techniques are available in the art including, for example, nucleic acid sequencing, nucleic acid hybridization, and nucleic acid amplification. Illustrative examples of nucleic acid sequencing techniques include, but are not limited to, chain terminator (Sanger) sequencing and dye terminator sequencing.

Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

Any method can be used for detecting either the non-amplified or amplified polynucleotides including, for example, Hybridization Protection Assay (HPA), quantitative evaluation of the amplification process in real-time, and determining the quantity of target sequence initially present in a sample, but which is not based on a real-time amplification.

Also provided are methods for identifying nucleic acids which do not necessarily require sequence amplification and are based on, for example, the known methods of Southern (DNA:DNA) blot hybridizations, in situ hybridization (ISH), and fluorescence in situ hybridization (FISH) of chromosomal material. Southern blotting can be used to detect specific nucleic acid sequences. In such methods, nucleic acid that is extracted from a sample is fragmented, electrophoretically separated on a matrix gel, and transferred to a membrane filter. The filter bound nucleic acid is subject to hybridization with a labeled probe complementary to the sequence of interest. Hybridized probe bound to the filter is detected. In any such methods, the process can include hybridization using any of the probes described or exemplified herein.

In hybridization techniques, stringent conditions can be employed such that a probe or primer will specifically hybridize to its target. In some embodiments, a polynucleotide primer or probe under stringent conditions will hybridize to its target sequence (e.g., the variant (e.g., E533D or E529D) GPR156 gene locus, variant (e.g., E533D or E529D) GPR156 mRNA, or variant (e.g., E533D or E529D) GPR156 cDNA) to a detectably greater degree than to other sequences (e.g., the corresponding wild type GPR156 locus, wild type mRNA, or wild type cDNA), such as, at least 2-fold, at least 3-fold, at least 4-fold, or more over background, including over 10-fold over background. In some embodiments, a polynucleotide primer or probe under stringent conditions will hybridize to its target sequence to a detectably greater degree than to other sequences by at least 2-fold. In some embodiments, a polynucleotide primer or probe under stringent conditions will hybridize to its target sequence to a detectably greater degree than to other sequences by at least 3-fold. In some embodiments, a polynucleotide primer or probe under stringent conditions will hybridize to its target sequence to a detectably greater degree than to other sequences by at least 4-fold. In some embodiments, a polynucleotide primer or probe under stringent conditions will hybridize to its target sequence to a detectably greater degree than to other sequences by over 10-fold over background. Stringent conditions are sequence-dependent and will be different in different circumstances. By controlling the stringency of the hybridization and/or washing conditions, target sequences that are 100% complementary to the probe can be identified (homologous probing). Alternately, stringency conditions can be adjusted to allow some mismatching in sequences so that lower degrees of identity are detected (heterologous probing).

Appropriate stringency conditions which promote DNA hybridization, for example, 6× sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for longer probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

In hybridization reactions, specificity is typically the function of post-hybridization washes, the critical factors being the ionic strength and temperature of the final wash solution. For DNA-DNA hybrids, the $T_m$ can be approximated from the equation of Meinkoth and Wahl, *Anal. Biochem.,* 1984, 138, 267-284: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≥90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1° C., 2° C., 3° C., or 4° C. lower than the thermal melting point ($T_m$); moderately stringent conditions can utilize a hybridization and/or wash at 6° C., 7° C., 8° C., 9° C., or 10° C. lower than the thermal melting point ($T_m$); low stringency conditions can utilize a hybridization and/or wash at 11° C., 12° C., 13° C., 14° C., 15° C., or 20° C. lower than the thermal melting point Using the equation, hybridization and wash compositions, and desired $T_m$, those of ordinary skill will understand that variations in the stringency of hybridization and/or wash solutions are inherently described. If the desired degree of mismatching results in a $T_m$ of less than 45'C (aqueous solution) or 32° C. (formamide solution), it is optimal to increase the SSC concentration so that a higher temperature can be used.

Also provided are methods for detecting the presence or quantifying the levels of variant GPR156 polypeptide in a biological sample, including, for example, protein sequencing and immunoassays. In some embodiments, the method of detecting the presence of GPR156 Glu533Asp (SEQ D NO:4 or SEQ ID NO:5, for example) in a human subject comprises performing an assay on a biological sample from the human subject that determines the presence of GPR156 Glu533Asp (SEQ ID NO:4 or SEQ ID NO:5, for example) in the biological sample.

Illustrative non-limiting examples of protein sequencing techniques include, but are not limited to, mass spectrometry and Edman degradation. Illustrative examples of immunoassays include, but are not limited to, immunoprecipitation, Western blot, immunohistochemistry, ELISA, immunocytochemistry, flow cytometry, and immuno-PCR. Polyclonal or monoclonal antibodies detectably labeled using various known techniques (e.g., calorimetric, fluorescent, chemiluminescent, or radioactive) are suitable for use in the immunoassays.

The present disclosure also provides methods for diagnosing unipolar depression or detecting a risk of unipolar depression in a human subject, comprising: detecting an alteration in a nucleic acid molecule encoding a GPR156 protein obtained from the human subject, wherein the alteration encodes an aspartic acid at the position corresponding to position 533 in the GPR156 protein according to SEQ ID NO:4, or at the position corresponding to position 529 according to SEQ ID NO:5; and diagnosing the human subject with unipolar depression if the subject has one or more symptoms of depression, including one or more symptoms of unipolar depression, or diagnosing the human subject as at risk for unipolar depression if the subject does not have one or more symptoms of depression. In some embodiments, the human subject is in need of such diagnosis. In some embodiments, the human subject may have relatives that have been diagnosed with unipolar depression. The alteration may comprise a change from a G to a T (or U) or a C at the position corresponding to position 1599 according to SEQ ID NO:13. In some embodiments, the alteration changes the sequence of the codon encoding the position corresponding to position 533 in the GPR156 protein to GAT (or GAU). In some embodiments, the alteration changes the sequence of the codon encoding the position corresponding to position 533 in the GPR156 protein to GAC.

The Diagnostic and Statistical Manual of Mental Disorders—Fifth Edition (DSM-V), published by the American Psychiatric Association, Washington D.C., 2013, is the primary diagnostic reference of Mental Health professionals in the United States. According to the DSM-V, unipolar depression consists of: major depressive disorder, dysthymic disorder, mixed depressive disorder, adjustment disorder with depressed mood, and depression not otherwise specified (NOS). DSMIV criteria for depression is for 2 weeks or more, five or more symptoms from the following: i) feeling depressed mood most of the day nearly every day; ii) markedly diminished interest or pleasure in all or almost all activities; iii) significant weight loss or decreased appetite; iv) insomnia or hypersomnia; v) psychomotor agitation or retardation; vi) fatigue or loss of energy; vii) feelings of worthlessness or excessive guilt; viii) diminished ability to think or concentrate or indecisiveness; and ix) recurrent thoughts of death. DSMIV criteria for dysthymic disorder is characterized by an overwhelming yet chronic state of depression, exhibited by a depressed mood for most of the days, for more days than not, for at least 2 years. The person who suffers from this disorder must not have gone for more than 2 months without experiencing two or more of the following symptoms: i) poor appetite or overeating; ii) insomnia or hypersomnia; iii) low energy or fatigue; iv) low self-esteem; v) poor concentration or difficulty making decisions; and vi) feelings of hopelessness.

The present disclosure also provides methods for diagnosing an anxiety disorder or detecting a risk of an anxiety disorder in a human subject, comprising: detecting an alteration in a nucleic acid molecule encoding a GPR156 protein obtained from the human subject, wherein the alteration encodes an aspartic acid at the position corresponding to position 533 in the GPR156 protein according to SEQ ID NO:4, or at the position corresponding to position 529 according to SEQ ID NO:5; and diagnosing the human subject with an anxiety disorder if the subject has one or more symptoms of an anxiety disorder, including one or more symptoms of clinical neuropsychiatric anxiety disorder, or diagnosing the human subject as at risk for an anxiety disorder if the subject does not have one or more symptoms of an anxiety disorder. In some embodiments, the human subject is in need of such diagnosis. In some embodiments, the human subject may have relatives that have been diagnosed with an anxiety disorder. The alteration may comprise a change from a G to a T (or U) or a C at the position corresponding to position 1599 according to SEQ ID NO:13. In some embodiments, the alteration changes the sequence of the codon encoding the position corresponding to position 533 in the GPR156 protein to GAT (or GAU). In some embodiments, the alteration changes the sequence of the codon encoding the position corresponding to position 533 in the GPR156 protein to GAC. In some embodiments, the anxiety disorder is clinical neuropsychiatric anxiety disorder.

Physiological symptoms of an anxiety disorder include, but are not limited to, muscle tension, heart palpitations, sweating, dizziness, and shortness of breath. Emotional symptoms include, but are not limited to, restlessness, a sense of impending doom, fear of dying, fear of embarrassment or humiliation, and fear of something terrible happening.

In some embodiments, the methods comprise detecting the presence of the variant GPR156 genomic DNA, mRNA, or cDNA obtained from mRNA obtained from a biological sample obtained from the subject. It is understood that gene sequences within a population and mRNAs encoded by such genes can vary due to polymorphisms such as single nucleotide polymorphisms (SNPs). The sequences provided herein for the GPR156 gene, mRNA, cDNA, and polypeptide are only exemplary sequences and other such sequences, including GPR156 alleles other than the alleles encoding aspartic acid at the positions corresponding to positions 533 (according to SEQ ID NO:4)/529 (according to SEQ I NO:5) in the GPR156 protein, are also possible.

In some embodiments, the detecting step comprises sequencing at least a portion of the nucleic acid molecule that encodes a GPR156 protein, wherein the sequenced nucleic acid molecule encodes an amino acid sequence which comprises the position corresponding to position 533 according to SEQ ID NO:4 or position 529 according to SEQ ID NO:5 of the GPR156 protein. Any of the nucleic acid molecules disclosed herein (e.g., genomic DNA, mRNA, or cDNA) can be sequenced. In some embodiments, the detecting step comprises sequencing the entire nucleic acid molecule.

In some embodiments, the detecting step comprises: amplifying at least a portion of the nucleic acid molecule that encodes a GPR156 protein, wherein the amplified nucleic acid molecule encodes an amino acid sequence which comprises the position corresponding to position 533 according to SEQ ID NO:4 (and/or to position 529 according to SEQ ID NO:5); labeling the nucleic acid molecule with a detectable label; contacting the labeled nucleic acid with a support comprising a probe, wherein the probe comprises a nucleic acid sequence which hybridizes under stringent conditions to a nucleic acid sequence encoding aspartic acid at the position corresponding to position at 533 according to SEQ ID NO:4 (and/or to position 529 according to SEQ ID NO:5); and detecting the detectable label. Any of the nucleic acid molecules disclosed herein can be amplified. For example, any of the genomic DNA, cDNA, or mRNA molecules disclosed herein can be amplified. In some embodiments, the nucleic acid molecule is mRNA and the method further comprises reverse-transcribing the mRNA into a cDNA prior to the amplifying step.

In some embodiments, the detecting step comprises: contacting the nucleic acid molecule with a probe comprising a detectable label, wherein the probe comprises a nucleic acid sequence which hybridizes under stringent conditions to a nucleic acid sequence encoding an amino acid sequence which comprises aspartic acid at the position corresponding to position 533 according to SEQ ID NO:4 (and/or to position 529 according to SEQ ID NO:5), and detecting the detectable label. In some embodiments, the nucleic acid molecule is present within a cell obtained from the human subject, such that the detection is according to an in situ hybridization technique.

In some embodiments, the detecting step comprises contacting the nucleic acid molecule with an allele-specific primer, and amplifying the nucleic acid molecule using allele-specific PCR techniques. The allele-specific primer may be any such primer described herein, and may be specific to alleles of GPR156 that encode an aspartic acid at the position corresponding to position 533 according to SEQ ID NO:4 and/or position 529 according to SEQ ID NO:5.

Other assays that can be used in the methods disclosed herein include, for example, reverse transcription polymerase chain reaction (RT-PCR) or quantitative RT-PCR (qRT-PCR). Yet other assays that can be used in the methods disclosed herein include, for example, RNA sequencing (RNA-Seq) followed by determination of the presence and quantity of variant mRNA or cDNA in the biological sample.

The present disclosure also provides methods for identifying a human subject having unipolar depression or a risk for developing unipolar depression. The methods generally comprise determining in a sample obtained from the subject the presence or absence of an E533D variation within the GPR156 protein; and/or the presence or absence of a nucleic acid molecule comprising a mutation encoding an E533D variation within the GPR156 protein. The presence of the E533D variation within the GPR156 protein and/or presence of a nucleic acid molecule encoding an E533D variation indicates that the subject has unipolar depression or a risk for developing unipolar depression. The method may be carried out in vitro, in situ, or in vivo.

The present disclosure also provides methods for identifying a human subject having an anxiety disorder or a risk for developing an anxiety disorder. The methods generally comprise determining in a sample obtained from the subject the presence or absence of an E533D variation within the GPR156 protein; and/or the presence or absence of a nucleic acid molecule comprising a mutation encoding an E533D variation within the GPR156 protein. The presence of the E533D variation within the GPR156 protein and/or presence of a nucleic acid molecule encoding an E533D variation indicates that the subject has an anxiety disorder or a risk for developing an anxiety disorder. The method may be carried out in vitro, in situ, or in vivo. In some embodiments, the anxiety disorder is clinical neuropsychiatric anxiety disorder.

In some embodiments of the method, the determining step comprises sequencing at least a portion of the nucleic acid molecule that encodes a GPR156 protein. The sequenced nucleic acid molecule may encode an amino acid sequence which comprises a position corresponding to position 533 according to SEQ ID NO:4. The determining step may comprise sequencing the nucleic acid molecule encoding the entire GPR156 protein. In some embodiments of the method, the determining step comprises amplifying at least a portion of the nucleic acid molecule that encodes a GPR156 protein, labeling the nucleic acid molecule with a detectable label, contacting the labeled nucleic acid with a support comprising a probe, wherein the probe comprises a nucleic acid sequence which specifically hybridizes, including, for example, under stringent conditions, to a nucleic acid sequence encoding aspartic acid at the position corresponding to position 533 according to SEQ ID NO:4, and detecting the detectable label. The amplified nucleic acid molecule preferably encodes an amino acid sequence which comprises the position corresponding to position 533 according to SEQ ID NO:4. If the nucleic acid includes mRNA, the method may further comprise reverse-transcribing the mRNA into a cDNA prior to the amplifying step. In some embodiments, the determining step comprises contacting the nucleic acid molecule with a probe comprising a detectable label and detecting the detectable label. The probe preferably comprises a nucleic acid sequence which specifically hybridizes, including, for example, under stringent conditions, to a nucleic acid sequence encoding an amino acid sequence which comprises aspartic acid at the position corresponding to position at 533 according to SEQ ID NO:4. The nucleic acid molecule may be present within a cell obtained from the human subject. As part of the method, the E533D variation within the GPR156 protein may be encoded by the nucleic acid sequence GAT, or may be encoded by the nucleic acid sequence GAC.

The present disclosure also provides methods for diagnosing unipolar depression or detecting a risk of unipolar depression in a human subject, comprising: detecting a variant GPR156 protein, such as a protein comprising SEQ ID NO:4 or SEQ ID NO:5, obtained from the human subject; and diagnosing the human subject with unipolar depression if the subject has one or more symptoms of depression, or diagnosing the human subject as at risk for unipolar depression if the subject does not have one or more symptoms of depression. In some embodiments, the human subject is in need of such diagnosis. In some embodiments, the human subject may have relatives that have been diagnosed with unipolar depression. In some embodiments, the depression or unipolar depression is not childhood depression and/or anxiety.

The present disclosure also provides methods for diagnosing an anxiety disorder or detecting a risk of an anxiety disorder in a human subject, comprising: detecting a variant GPR156 protein, such as a protein comprising SEQ ID NO:4 or SEQ ID NO:5, obtained from the human subject; and diagnosing the human subject with an anxiety disorder if the subject has one or more symptoms of an anxiety disorder, or diagnosing the human subject as at risk for an anxiety disorder if the subject does not have one or more symptoms of an anxiety disorder. In some embodiments, the human subject is in need of such diagnosis. In some embodiments, the human subject may have relatives that have been diagnosed with an anxiety disorder. In some embodiments, the anxiety disorder is clinical neuropsychiatric anxiety disorder.

In some embodiments, the method further comprises treating the subject with an antidepressant when the alteration is detected in the subject and the subject is diagnosed as having unipolar depression.

In some embodiments, the antidepressant is a selective serotonin reuptake inhibitor (SSRI). Suitable examples of SSRIs include, but are not limited to, Citalopram) (Celexa®), Escitalopram (Lexapro®, Cipralex®), Paroxetine (Paxil®,Seroxat®), Fluoxetine (Prozac®), Fluvoxamine (Luvox®), and Sertraline (Zoloft®, Lustral®).

In some embodiments, the antidepressant is a serotonin-norepinephrine reuptake inhibitor (SNRA). Suitable examples of SNRIs include, but are not limited to, Desvenlafaxine (Pristiq®), Duloxetine (Cymbalta®), Levomilnacipran (Fetzima®), Milnacipran (Ixel®, Savella®), Tofenacen (Elamol®,Tofacine®), and Venlafaxine (Effexor®).

In some embodiments, the antidepressant is a norepinephrine reuptake inhibitor (NRI). Suitable examples of NRIs include, but are not limited to, Reboxetine (Edronax®), Viloxazine (Vivalan®), and Atomoxetine (Strattera).

In some embodiments, the antidepressant is lithium.

In some embodiments, the antidepressant is a serotonin modulator and stimulator (SMS). Suitable examples of SMSs include, but are not limited to, Vilazodone (Viibryd®) and Vortioxetine (Trintellix®).

In some embodiments, the antidepressant is a serotonin antagonist and reuptake inhibitor (SARI). Suitable examples of SARIs include, but are not limited to, Etoperidone (Axiomin®, Etonin®), Nefazodone (Nefadar®, Serzone®), and Trazodone (Desyrel®).

In some embodiments, the antidepressant is a tricyclic antidepressant (TCA). Suitable examples of TCAs include, but are not limited to, Amitriptyline (Elavil®, Endep®), Amitriptylinoxide (Amioxid®, Ambivalon®, Equilibrin®), Clomipramine (Anafranil®), Desipramine (Norpramin®, Pertofrane®), Dibenzepin (Noveril®, Victoril®), Dimetacrine (Istonil®), Dosulepin (Prothiaden®), Doxepin (Adapin®, Sinequan®), Imipramine (Tofranil®), Lofepramine (Lomont®, Gamanil®), Melitracen (Dixeran®, Melixeran®, Trausabun®), Nitroxazepine (Sintamil®), Nortriptyline (Pamelor®, Aventyl®), Noxiptiline (Agedal®, Elronon®, Nogedal®), Pipofezine (Azafen®/Azaphen®), Protriptyline (Vivactil®), and Trimipramine (Surmontil®). Also included are Butriptyline (Evadyne®), demexiptiline (Deparon®, Tinoran®), Imipraminoxide (Imiprex®, Elepsin®), iprindole (Prondol®, Galatur®, Tetran®), metapramine (Timaxel®), propizepine (Depressin®, Vagran®), and quinupramine (Kinupril®, Kevopril®). Also included are Opipramol (Insidon®) and Tianeptine (Stablon®).

In some embodiments, the antidepressant is a tetracyclic antidepressants (TeCA). Suitable examples of TeCAs include, but are not limited to, Amoxapine (Asendin®), Maprotiline (Ludiomil®), Mianserin (Bolvidon®, Norval®, Tolvon®), Mirtazapine (Remeron®), and Setiptiline (Tecipul®).

In some embodiments, the antidepressant is a monoamine oxidase inhibitors (MAOI). Suitable examples of MAOIs include, but are not limited to, Iproniazid (Marsilid®), Isocarboxazid (Marplan®), Phenelzine (Nardil®), Selegiline (Eldepryl®, Zelapar®, Emsam®), Tranylcypromine (Parnate®), Metralindole (Inkazan®), Moclobemide (Aurorix®, Manerix®), Pirlindole (Pirazidol®), and Toloxatone (Humoryl®). Others include, for example, benmoxin (Neuralex®), Caroxazone (Surodil®, Timostenil®), iproclozide (Sursum®), mebanazine) (Actomol®), nialamide (Niamid®), octamoxin (Ximaol®), pheniprazine (Catron®), phenoxypropazine (Drazine®), pivhydrazine (Tersavid®), safrazine (Safra®), Eprobemide (Befol®), and minaprine (Brantur®, Cantor®).

In some embodiments, the antidepressant is an atypical antipsychotic. Suitable examples of atypical antipsychotic include, but are not limited to, Amisulpride (Solian®), Lurasidone (Latuda®), and Quetiapine (Seroquel®).

In some embodiments, the antidepressant is Agomelatine (Valdoxan®), Bifemelane (Alnert®, Celeport®), Bupropion (Wellbutrin®), Ketamine (Ketalar®), Tandospirone (Sediel®), or Teniloxazine (Lucelan®, Metatone®).

In some embodiments, the method further comprises treating the subject with an anxiolytic agent when the alteration is detected in the subject and the subject is diagnosed as having an anxiety disorder. In some embodiments, the anxiety disorder is clinical neuropsychiatric anxiety disorder.

In some embodiments, the anxiolytic agent is a benzodiazepine, including but not limited to, Alprazolam (Xanax®), Bromazepam (Lectopam®, Lexotan®), Chlordiazepoxide (Librium®), Clonazepam (Klonopin®, Rivotril®), Clorazepate (Tranxene®), Diazepam (Valium®), Flurazepam (Dalmane®), Lorazepam (Ativan®), Oxazepam (Serax®, Serapax®), Temazepam (Restoril®), Triazolam (Halcion®), and Tofisopam (Emandaxin®, Grandaxin®).

In some embodiments, the anxiolytic agent is a carbamate, including but not limited to, meprobamate (Miltown®, Equanil®).

In some embodiments, the anxiolytic agent is an antihistamine, including but not limited to, Hydroxyzine (Atarax®), Chlorpheniramine (Chlor-Trimeton®), and diphenhydramine (Benadryl®).

In some embodiments, the anxiolytic agent is an azapirone, including but not limited to, Buspirone (Buspar®) and Tandospirone (Sediel®).

In some embodiments, the anxiolytic agent is an SSRI, SNRI, TCA, TeCA, or MAOI, as described herein.

In some embodiments, the anxiolytic agent is Mebicar (Mebicarum®), Fabomotizole (Afobazole®), Selank, Bromantane, Emoxypine, Pregabalin, Menthyl isovalerate, or Menthyl isovalerate (Validol®).

Administration of the antidepressant or anxiolytic agents can be by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The present disclosure also provides antidepressants for use in the treatment of unipolar depression in a human subject comprising an alteration in a gene encoding the human GPR156 protein, wherein the alteration encodes an aspartic acid at the position corresponding to position 533 according to SEQ ID NO:4 or to position 529 according to SEQ ID NO:4. The disclosure further provides antidepressants for use in the manufacture of a medicament for the treatment of unipolar depression in a human subject comprising an alteration in a gene encoding the human GPR156 protein, wherein the alteration encodes an aspartic acid at the position corresponding to position 533 according to SEQ ID NO:4 or to position 529 according to SEQ ID NO:5 in the human GPR156 protein. In some embodiments, the alteration changes the sequence of the codon encoding the position corresponding to position 533 according to SEQ ID NO:4 or to position 529 according to SEQ ID NO:5 to GAT (or GAU). In some embodiments, the alteration changes the sequence of the codon encoding the position corresponding to position 533 according to SEQ ID NO:4 or to position 529 according to SEQ ID NO:5 to GAC. In some embodiments, the antidepressant is a selective serotonin reuptake inhibitor, a serotonin-norepinephrine reuptake inhibitor, or a norepinephrine reuptake inhibitor. In some embodiments, the antidepressant is lithium.

In some embodiments of the antidepressant for use in the treatment of unipolar depression in a human subject, the human subject has been tested positive for the E533D variation within the GPR156 protein and/or for a nucleic acid molecule encoding the E533D variation within the GPR156 protein. In some embodiments, the treatment comprises the step of determining whether or not the human subject has a GPR156 protein with the E533D variation and/or a nucleic acid molecule encoding a GPR156 protein with the E533D variation. In some embodiments, the human subject has been identified as having unipolar depression or as having a risk for developing unipolar depression according to a method for identifying a human subject having unipolar depression or a risk for developing unipolar depression, including any such method described or exemplified herein. The E533D variation refers to a mutation resulting in an aspartic acid at the position corresponding to position 533 according to SEQ ID NO:4. In some embodiments, the E533D variation within the GPR156 protein is encoded by the codon GAT. In some embodiments, the E533D variation within the GPR156 protein is encoded by the codon GAC. In some embodiments, the antidepressant for use in the treatment of unipolar depression in a human subject is a selective serotonin reuptake inhibitor, a serotonin-norepinephrine reuptake inhibitor, or a norepinephrine reuptake inhibitor. In some embodiments, the antidepressant for the use in the treatment of unipolar depression in a human subject is lithium.

The present disclosure also provides anxiolytic agents for use in the treatment of an anxiety disorder in a human subject comprising an alteration in a gene encoding the human GPR156 protein, wherein the alteration encodes an aspartic acid at the position corresponding to position 533 according to SEQ ID NO:4 or to position 529 according to SEQ ID NO:4. The disclosure further provides anxiolytic agents for use in the manufacture of a medicament for the treatment of an anxiety disorder in a human subject comprising an alteration in a gene encoding the human GPR156 protein, wherein the alteration encodes an aspartic acid at the position corresponding to position 533 according to SEQ ID NO:4 or to position 529 according to SEQ ID NO:5 in the human GPR156 protein. In some embodiments, the alteration changes the sequence of the codon encoding the position corresponding to position 533 according to SEQ ID NO:4 or to position 529 according to SEQ ID NO:5 to GAT (or GAU). In some embodiments, the alteration changes the sequence of the codon encoding the position corresponding to position 533 according to SEQ ID NO:4 or to position 529 according to SEQ ID NO:5 to GAC. In some embodiments, the anxiolytic agent is a benzodiazepine, a carbamate, an antihistamine, an azapirone, an SSRI, an SNRI, a TCA, a TeCA, or an MAOI. In some embodiments, the anxiety disorder is clinical neuropsychiatric anxiety disorder.

In some embodiments of the anxiolytic agent for use in the treatment of an anxiety disorder in a human subject, the human subject has been tested positive for the E533D variation within the GPR156 protein and/or for a nucleic acid molecule encoding the E533D variation within the GPR156 protein. In some embodiments, the treatment comprises the step of determining whether or not the human subject has a GPR156 protein with the E533D variation and/or a nucleic acid molecule encoding a GPR156 protein with the E533D variation. In some embodiments, the human subject has been identified as having an anxiety disorder or as having a risk for developing an anxiety disorder according to a method for identifying a human subject having an anxiety disorder or a risk for developing an anxiety disorder, including any such method described or exemplified herein. The E533D variation refers to a mutation resulting in an aspartic acid at the position corresponding to position 533 according to SEQ ID NO:4. In some embodiments, the E533D variation within the GPR156 protein is encoded by the codon GAT. In some embodiments, the E533D variation within the GPR156 protein is encoded by the codon GAC. In some embodiments, the anxiolytic agent for use in the treatment of an anxiety disorder in a human subject is a benzodiazepine, a carbamate, an antihistamine, an azapirone, an SSRI, an SNRI, a TCA, a TeCA, or an MAOI. In some embodiments, the anxiety disorder is clinical neuropsychiatric anxiety disorder.

The present disclosure also provides uses of any of the variant GPR156 genes, mRNAs, cDNAs, polypeptides, and hybridizing nucleic acid molecules disclosed herein in the diagnosis of unipolar depression or diagnosing the risk of developing unipolar depression.

The present disclosure also provides uses of any of the variant GPR156 genes, mRNAs, cDNAs, polypeptides, and hybridizing nucleic acid molecules disclosed herein in the diagnosis of an anxiety disorder or diagnosing the risk of developing an anxiety disorder. In some embodiments, the anxiety disorder is clinical neuropsychiatric anxiety disorder.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The nucleotide and amino acid sequences recited herein are shown using standard letter abbreviations for nucleotide bases, and one-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequences follow the standard convention of beginning at the amino terminus of the sequence and proceeding forward (i.e., from left to right in each line) to the carboxy terminus.

The following examples are provided to describe the embodiments in greater detail. They are intended to illustrate, not to limit, the claimed embodiments.

EXAMPLES

The following examples are put forth so as to provide those of ordinary skill in the art with a complete disclosure and description of how the compounds, compositions, articles, devices and/or methods claimed herein are made and evaluated, and are intended to be purely exemplary and are not intended to limit the scope of what the inventors regard as their invention. Efforts have been made to ensure accuracy with respect to numbers (e.g., amounts, temperature, etc.), but some errors and deviations should be accounted for. Unless indicated otherwise, parts are parts by weight, temperature is in ° C. or is at ambient temperature, and pressure is at or near atmospheric.

Example 1

Patient Recruitment and Phenotyping

Whole exome sequencing was performed in a family of Mennonite ancestry that had been ascertained for genetic evaluation of unipolar depression. Individuals in this pedigree were additionally systematically evaluated by a neuropsychiatric team using a Structured Clinical Interview for DSM-5 (SCID-5). This semi-structured interview is administered by a trained mental health professional, and is designed to ensure systematic and accurate diagnosis of DSM-5 disorders. That interview was used to determine if individuals and their relatives meet criteria for Major Depression, Generalized Anxiety Disorder, and any other comorbid psychiatric conditions. The interview typically took one to two hours to conduct with the subject. In addition to the interview, collateral information was gathered to confirm diagnoses from the subject's medical records, treatment providers, and close contacts with the subject's written consent. The exomes of all available affected and unaffected family members in this large pedigree encompassing a total of 50 individuals were sequenced.

Example 2

Genomic Samples

Genomic DNA was extracted from peripheral blood samples and transferred to the Regeneron Genetics Center (RGC) for whole exome sequencing, and stored in automated biobanks at −80° C. Fluorescence-based quantification was performed to ensure appropriate DNA quantity and quality for sequencing purposes.

1 μg of DNA was sheared to an average fragment length of 150 base pairs (Covaris LE220) and prepared for exome capture with a custom reagent kit from Kapa Biosystems. Samples were captured using the NimbleGen SeqCap VCRome 2.1 or the Integrated DNA Technologies xGen exome target designs. Samples were barcoded, pooled, and multiplexed for sequenced using 75 bp paired-end sequencing on an Illumina HiSeq 2500 with v4 chemistry. Captured fragments were sequenced to achieve a minimum of 85% of the target bases covered at 20× or greater coverage. Following sequencing, data was processed using a cloud-based pipeline developed at the RGC that uses DNAnexus and AWS to run standard tools for sample-level data production and analysis. Briefly, sequence data were generated and de-multiplexed using Illumina's CASAVA software. Sequence reads were mapped and aligned to the GRCh37/hg19 human genome reference assembly using BWA-mem. After alignment, duplicate reads were marked and flagged using Picard tools and indels were realigned using GATK to improve variant call quality. SNP and INDEL variants and genotypes were called using GATK's HaplotypeCaller and Variant Quality Score Recalibration (VQSR) from GATK was applied to annotate the overall variant quality scores. Sequencing and data quality metric statistics were captured for each sample to evaluate capture performance, alignment performance, and variant calling.

Example 3

Genomic Data Analyses

Standard quality-control filters for minimum read depth (>10), genotype quality (>30), and allelic balance (>15%) were applied to called variants. Passing variants were classified and annotated based on their potential functional effects (whether synonymous, nonsynonymous, splicing, frameshift, or nonframeshift variants) using an RGC developed annotation and analysis pipeline. Familial relationships were verified through identity by descent (IBD) derived metrics from genetic data to infer relatedness and relationships in the cohort using PRIMUS (Staples et al., Amer. J. Human Genet., 2014, 95, 553-564) and cross-referencing with the reported pedigree for this family.

Pedigree-based variant analyses and segregation were performed to identify candidate disease genes under an autosomal dominant inheritance pattern given the reported family history. Primary analysis was performed using as many informative affected individuals that were available for sequencing to reduce potential confounders given by incomplete penetrance of the disorder, age of onset, or potential exposure to environmental factors that may trigger symptomatic presentation of the disease. Shared variants among all affected individuals were subsequently annotated and filtered by their observed frequencies in population control databases such as dbSNP, the 1000 Genomes Project, the NHLBI Exome Sequencing Project, the Exome Aggregation Consortium Database (ExAc), and internal RGC databases to filter out common polymorphisms and high frequency, likely benign variants. Algorithms for bioinformatic prediction of functional effects of variants, such as LRT, Poly-phen2, SIFT, CADD, and Mutation Taster, along with conservation scores based on multiple species alignments (i.e. GERP, PhastCons, PhyloP) were incorporated as part of the annotation process of variants and used to inform on the potential deleteriousness of identified candidate variants.

A single rare variant was identified in the gene GPR156 (hg19.g.chr3:119886725(C>A); c.1599G>T; p.Glu533Asp, p.E533D) segregating with the phenotype of unipolar depression in the affected family members of this pedigree. Additional family members not included in the primary analysis but that also carried the p.E533D variants had confirmed diagnoses of anxiety disorder. To exclude other possible variants segregating with the depression or anxiety disorder phenotype in this family, single point exome-wide and multi-point genome-wide linkage analyses were performed using a customized RGC developed pipeline based on the published MERLIN algorithm (Abecasis et al., Nat. Genet., 2002, 30). Briefly, parametric linkage analysis of SNP chip and exome derived genotypes was performed using MERLIN (csg.sph.umich.edu/abecasis/merlin/index.html). PLINK formatted genotypes were restricted to single nucleotide variants (SNVs) present in at least one non-founder. Allele frequencies were estimated in founders and other unrelated members of the pedigree. Individuals without genetic data were assigned missing/dummy genotypes. fcGENE (sourceforge.net/projects/fcgene/) was used to convert PLINK format genotypes to MERLIN formatted ped files. Additional files (.dat and .map) necessary for linkage analysis were prepared using customized scripts. The pedigree structure was validated using Pedstats (csg.sph.umich.edu/abecasis/pedstats/index.html). Linkage analysis of chip data was carried out using either step-wise or grid spacing between genotypes with no assumptions about recombination. Single-point linkage was used to analyze exome based genotypes. For all analyses, an incomplete penetrance model was assumed (0.0001, 0.75, 1) with a disease allele frequency of approximately of 0.01%.

For both exome-wide and genome-wide analyses, a single peak of linkage was identified in this pedigree reaching a maximum LOD score of 2.98 and expanding a 14.4 Megabase (Mb) region in human chromosome 3. Within this linkage region the GPR156 gene is located and the candidate variant (c.1599G>T, p.Glu533Asp) identified through the initial rare-variant family-based segregation analysis achieved a single marker LOD score of 2.56.

As demonstrated herein, these genetic analyses indicate that GPR156 is a gene associated with increased familial susceptibility to unipolar depression and anxiety disorder.

Figure 2:
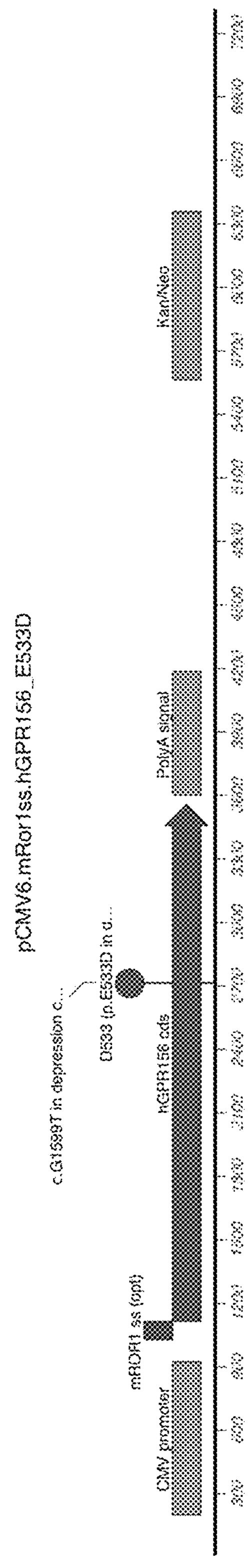
FIG. 2 shows a vector map of mRor1ss.hGPR156_E533D expression vector.

Additionally, nucleotide fragments comprising the wild type and mutant E533D sequences were subcloned into a vector (see, FIGS. 1 and 2) to obtain wild type and variant E533D GPR156 constructs for additional analyses.

Example 4

Detection

The presence of a certain genetic variant in a subject can indicate that the subject has an increased risk of having or developing a unipolar depression. A sample, such as a blood sample, can be obtained from a subject. Nucleic acids can be isolated from the sample using common nucleic acid extraction kits. After isolating the nucleic acid from the sample obtained from the subject, the nucleic acid is sequenced to determine if there is a genetic variant present. The sequence of the nucleic acid can be compared to a control sequence (wild type sequence). Finding a difference between the nucleic acid obtained from the sample obtained from the subject and the control sequence indicates the presence of a genetic variant. These steps can be performed as described in the examples above and throughout the present disclosure. The presence of one or more genetic variants is indicative of the subject's increased risk for having or developing unipolar depression.

Each reference (including, but not limited to, journal articles, U.S. and non-U.S. patents, patent application publications, international patent application publications, gene bank accession numbers, and the like) cited in the present application is incorporated herein by reference in its entirety.

SEQUENCE LISTING (42 sequences)

SEQ ID NO: 1 - protein, 814 aa, Homo sapien
  Wild type GPR156 isoform 1 protein
  MOD_RES (516)..(516): Xaa is glutamic acid or aspartic acid
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPXRGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 2 - protein, 810 aa, Homo sapien
  Wild type GPR156 isoform 2 protein
  MOD_RES (512)..(512): Xaa is glutamic acid or aspartic acid
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPXRGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 3 - protein, 505 aa, Artificial Sequence
  Wild type GPR156 protein, fragment 310-814
  MOD_RES (207)..(207): Xaa is glutamic acid or aspartic acid
PQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPXRGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 4 - protein, 814 aa, Homo sapien
  E533D GPR156 canonical protein
  MOD_RES (516)..(516): Xaa is glutamic acid or aspartic acid
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPXRGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 5 - protein, 810 aa, Homo sapien
  E529D GPR156 isoform protein
  MOD_RES (512)..(512): Xaa is glutamic acid or aspartic acid
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPXRGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 6 - protein, 505 aa, Artificial Sequence
  E553D GPR156 310-814 fragment protein
  MOD_RES (207)..(207): Xaa is glutamic acid or aspartic acid
PQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPXRGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 7 - DNA, 120450 bp, Homo sapien
  Wild type GPR156 isoform 1 genomic DNA
  variation (117166) .. (117166): n is a, g, t, or c
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtcagtatgacggtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 8 - DNA, 120438 bp, Homo sapien
  Wild type GPR156 isoform 2 genomic DNA
  variation (117154) .. (117154): n is a, g, t, or c
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 9 - DNA, 120450 bp, Homo sapien
  E533D GPR156 GAT genomic DNA
  variation (117166) .. (117166): n is a, g, t, or c
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtcagtatgacggtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggatcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 10 - DNA, 120450 bp, Homo sapien
  E533D GPR156 GAC genomic DNA
  variation (117166) .. (117166): n is a, g, t, or c
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtcagtatgacggtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggaccccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 11 - DNA, 120438 bp, Homo sapien
  E529D GPR156 isomer GAT genomic DNA
  variation (117154) .. (117154): n is a, g, t, or c
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggatcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 12 - DNA, 120438 bp, Homo sapien
  E529D GPR156 isomer GAC genomic DNA
  variation (117154) .. (117154): n is a, g, t, or c
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggaccccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 13 - DNA, 2442 bp, Artificial Sequence
  Wild type GPR156 isoform 1 cDNA
  variation (1548) .. (1548): n is a, g, t, or c
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 14 - DNA, 2430 bp, Artificial Sequence
  Wild type GPR156 isoform 2 cDNA
  variation (1536) .. (1536): n is a, g, t, or c
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 15 - DNA, 1515 bp, Artificial Sequence
  Wild type GPR156 cDNA, fragment 310-814
  variation (621) .. (621): n is a, g, t, or c
ccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 16 - DNA, 2442 bp, Artificial Sequence
  E533D GPR156 GAT cDNA
  variation (1548) .. (1548): n is a, g, t, or c
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggatcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 17 - DNA, 2442 bp, Artificial Sequence
  E533D GPR156 GAC cDNA
  variation (1548) .. (1548): n is a, g, t, or c
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggaccccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 18 - DNA, 2430 bp, Artificial Sequence
  E529D GPR156 GAT cDNA
  variation (1536) .. (1536): n is a, g, t, or c
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggatcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 19 - DNA, 2430 bp, Artificial Sequence
  E529D GPR156 GAC cDNA
  variation (1536) .. (1536): n is a, g, t, or c
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggaccccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 20 - DNA, 1515 bp, Artificial Sequence
  E533D GPR156 GAT cDNA, fragment 310-814
  variation (621) .. (621): n is a, g, t, or c
ccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggatcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 21 - DNA, 1515 bp, Artificial Sequence
  E533D GPR156 GAC cDNA, fragment 310-814
  variation (621) .. (621): n is a, g, t, or c
ccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggaccccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 22 - DNA, 2442 bp, Artificial Sequence
  Wild Type GPR156 isoform 1 mRNA
  variation (1548) .. (1548): n is a, g, u, or c
auggagccugaaauaaacugcucugaauugugugacaguuuuccuggccaggagcuggaucggagaccccuucaugaucucugcaagacaacaauuacaucuucccaccacagcaguaagaccaucucuucauuaucuccuguccucuuggguauuguuuggacuuuucucagcuguggacuucugcugauacuuuucuuucuugccuuuacaauucacugcaggaagaacaggauugugaagauguccagucccaaucugaacauugugaccuuacugggcaguugucucacuuacaguagcgcuuaccucuuugggauucaggauguuuuaguggggagcucaauggaaacucucauucagacaagacuguccaugcugugcauugggaccucccuuguguuuggccccauucugggaaagagcuggcgacucuacaagguguuuacccaaagggucccggacaagagagugauuaucaaagaccugcaguugcugggguugguggcagcccuguugauggcugaugugauccugcucaugacgugggugcugacugaucccauccagugccuccagauucucagugucaguaugacggugacagggaaagacguguccugcacuucgaccagcacccacuucugugcuucccgguauuccgauguuuggauugcucucauuuggggaugcaagggucugcuccugcuguauggugccuaccuggcuggccugacuggccaugucagcuccccuccugugaaucaguccuuaaccaucauggugggggucaaccuccuuguacuggcugcugggcugcuuuuuguagucaccagauacuugcauuccuggcccaaccuggucuuuggacucacaucuggagggaucuuuguuuguacaacuacaaucaacugcuucaucuucauuccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggagcccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 23 - DNA, 2430 bp, Homo sapien
  Wild Type GPR156 isoform 2 mRNA
  variation (1536) .. (1536): n is a, g, u, or c
auggagccugaaauaaacugcucugaauugugugacaguuuuccuggccaggagcuggaucggagaccccuucaugaucucugcaagacaacaauuacaucuucccaccacagcaguaagaccaucucuucauuaucuccuguccucuuggguauuguuuggacuuuucucagcuguggacuucugcugauacuuuucuuucuugccuuuacaauucacugcaggaagaacaggauugugaagauguccagucccaaucugaacauugugaccuuacugggcaguugucucacuuacaguagcgcuuaccucuuugggauucaggauguuuuaguggggagcucaauggaaacucucauucagacaagacuguccaugcugugcauugggaccucccuuguguuuggccccauucugggaaagagcuggcgacucuacaagguguuuacccaaagggucccggacaagagagugauuaucaaagaccugcaguugcugggguugguggcagcccuguugauggcugaugugauccugcucaugacgugggugcugacugaucccauccagugccuccagauucucagugugacagggaaagacguguccugcacuucgaccagcacccacuucugugcuucccgguauuccgauguuuggauugcucucauuuggggaugcaagggucugcuccugcuguauggugccuaccuggcuggccugacuggccaugucagcuccccuccugugaaucaguccuuaaccaucauggugggggucaaccuccuuguacuggcugcugggcugcuuuuuguagucaccagauacuugcauuccuggcccaaccuggucuuuggacucacaucuggagggaucuuuguuuguacaacuacaaucaacugcuucaucuucauuccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggagcccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 24 - DNA, 1515 bp, Homo sapien
  Wild Type GPR156 mRNA, fragment 310-814
  variation (621) .. (621): n is a, g, u, or c
ccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggagcccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 25 - DNA, 2442 bp, Homo sapien
  E533D GPR156 GAU mRNA
  variation (1548) .. (1548): n is a, g, u, or c
auggagccugaaauaaacugcucugaauugugugacaguuuuccuggccaggagcuggaucggagaccccuucaugaucucugcaagacaacaauuacaucuucccaccacagcaguaagaccaucucuucauuaucuccuguccucuuggguauuguuuggacuuuucucagcuguggacuucugcugauacuuuucuuucuugccuuuacaauucacugcaggaagaacaggauugugaagauguccagucccaaucugaacauugugaccuuacugggcaguugucucacuuacaguagcgcuuaccucuuugggauucaggauguuuuaguggggagcucaauggaaacucucauucagacaagacuguccaugcugugcauugggaccucccuuguguuuggccccauucugggaaagagcuggcgacucuacaagguguuuacccaaagggucccggacaagagagugauuaucaaagaccugcaguugcugggguugguggcagcccuguugauggcugaugugauccugcucaugacgugggugcugacugaucccauccagugccuccagauucucagugucaguaugacggugacagggaaagacguguccugcacuucgaccagcacccacuucugugcuucccgguauuccgauguuuggauugcucucauuuggggaugcaagggucugcuccugcuguauggugccuaccuggcuggccugacuggccaugucagcuccccuccugugaaucaguccuuaaccaucauggugggggucaaccuccuuguacuggcugcugggcugcuuuuuguagucaccagauacuugcauuccuggcccaaccuggucuuuggacucacaucuggagggaucuuuguuuguacaacuacaaucaacugcuucaucuucauuccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggaucccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 26 - DNA, 2442 bp, Homo sapien
  E533D GPR156 GAC mRNA
  variation (1548) .. (1548): n is a, g, u, or c
auggagccugaaauaaacugcucugaauugugugacaguuuuccuggccaggagcuggaucggagaccccuucaugaucucugcaagacaacaauuacaucuucccaccacagcaguaagaccaucucuucauuaucuccuguccucuuggguauuguuuggacuuuucucagcuguggacuucugcugauacuuuucuuucuugccuuuacaauucacugcaggaagaacaggauugugaagauguccagucccaaucugaacauugugaccuuacugggcaguugucucacuuacaguagcgcuuaccucuuugggauucaggauguuuuaguggggagcucaauggaaacucucauucagacaagacuguccaugcugugcauugggaccucccuuguguuuggccccauucugggaaagagcuggcgacucuacaagguguuuacccaaagggucccggacaagagagugauuaucaaagaccugcaguugcugggguugguggcagcccuguugauggcugaugugauccugcucaugacgugggugcugacugaucccauccagugccuccagauucucagugucaguaugacggugacagggaaagacguguccugcacuucgaccagcacccacuucugugcuucccgguauuccgauguuuggauugcucucauuuggggaugcaagggucugcuccugcuguauggugccuaccuggcuggccugacuggccaugucagcuccccuccugugaaucaguccuuaaccaucauggugggggucaaccuccuuguacuggcugcugggcugcuuuuuguagucaccagauacuugcauuccuggcccaaccuggucuuuggacucacaucuggagggaucuuuguuuguacaacuacaaucaacugcuucaucuucauuccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggaccccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 27 - DNA, 2430 bp, Homo sapien
  E529D GPR156 GAU mRNA
  variation (1536) .. (1536): n is a, g, u, or c
auggagccugaaauaaacugcucugaauugugugacaguuuuccuggccaggagcuggaucggagaccccuucaugaucucugcaagacaacaauuacaucuucccaccacagcaguaagaccaucucuucauuaucuccuguccucuuggguauuguuuggacuuuucucagcuguggacuucugcugauacuuuucuuucuugccuuuacaauucacugcaggaagaacaggauugugaagauguccagucccaaucugaacauugugaccuuacugggcaguugucucacuuacaguagcgcuuaccucuuugggauucaggauguuuuaguggggagcucaauggaaacucucauucagacaagacuguccaugcugugcauugggaccucccuuguguuuggccccauucugggaaagagcuggcgacucuacaagguguuuacccaaagggucccggacaagagagugauuaucaaagaccugcaguugcugggguugguggcagcccuguugauggcugaugugauccugcucaugacgugggugcugacugaucccauccagugccuccagauucucagugugacagggaaagacguguccugcacuucgaccagcacccacuucugugcuucccgguauuccgauguuuggauugcucucauuuggggaugcaagggucugcuccugcuguauggugccuaccuggcuggccugacuggccaugucagcuccccuccugugaaucaguccuuaaccaucauggugggggucaaccuccuuguacuggcugcugggcugcuuuuuguagucaccagauacuugcauuccuggcccaaccuggucuuuggacucacaucuggagggaucuuuguuuguacaacuacaaucaacugcuucaucuucauuccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggaucccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 28 - DNA, 2430 bp, Homo sapien
  E529D GPR156 GAC mRNA
  variation (1536) .. (1536): n is a, g, u, or c
auggagccugaaauaaacugcucugaauugugugacaguuuuccuggccaggagcuggaucggagaccccuucaugaucucugcaagacaacaauuacaucuucccaccacagcaguaagaccaucucuucauuaucuccuguccucuuggguauuguuuggacuuuucucagcuguggacuucugcugauacuuuucuuucuugccuuuacaauucacugcaggaagaacaggauugugaagauguccagucccaaucugaacauugugaccuuacugggcaguugucucacuuacaguagcgcuuaccucuuugggauucaggauguuuuaguggggagcucaauggaaacucucauucagacaagacuguccaugcugugcauugggaccucccuuguguuuggccccauucugggaaagagcuggcgacucuacaagguguuuacccaaagggucccggacaagagagugauuaucaaagaccugcaguugcugggguugguggcagcccuguugauggcugaugugauccugcucaugacgugggugcugacugaucccauccagugccuccagauucucagugugacagggaaagacguguccugcacuucgaccagcacccacuucugugcuucccgguauuccgauguuuggauugcucucauuuggggaugcaagggucugcuccugcuguauggugccuaccuggcuggccugacuggccaugucagcuccccuccugugaaucaguccuuaaccaucauggugggggucaaccuccuuguacuggcugcugggcugcuuuuuguagucaccagauacuugcauuccuggcccaaccuggucuuuggacucacaucuggagggaucuuuguuuguacaacuacaaucaacugcuucaucuucauuccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggaccccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 29 - DNA, 1515 bp, Homo sapien
  E533D GPR156 GAU mRNA, fragment 310-814
  variation (621) .. (621): n is a, g, u, or c
ccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggaucccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 30 - DNA, 1515 bp, Artificial Sequence
  E533D GPR156 GAC mRNA, fragment 310-814
  variation (621) .. (621): n is a, g, u, or c
ccccagcugaagcaauggaaggcauuugaagaggaaaaccaaacaaucagacgcauggccaaauauuucagcacucccaacaaaagcuuccauacccaguauggugaggaggagaacugccacccgaggggagagaaaagcuccauggagaggcuccucacagaaaaaaaugcugugauugaaagccugcaggaacaaguaaacaacgccaaagagaagauugugaggcugaugucagcugagugcaccuaugaccucccagagggggcugccccaccugccucuuccccgaacaaggacguccaggcgguagccucgguccacacccuggcagcugcucaggggccuucgggucaccucucugacuuucagaaugauccuggcauggcugcccgggauucccagugcacuucagggcccuccucauaugcacaaagccuugaggggccugggaaggacuccagcuucuccccagggaaggaggagaagauaucugacucaaaagacuuuucugaucauuuagacucagguuguagccagaagccauggacugagcaaagccuggguccagaaagaggagaccaaguccccaugaaccccagccagagucuccuaccaganagaggcggcucagauccccagagacagaggcaucuggagaacucagaggaccccccagagcggcggucacggguuaguucaguaaucagggagaaacuucaggaggucuuacaagaucugggccugggcccugaggcuucccucuccaccgcccccucuugucaucagcaaaccuggaagaacagugcugccuucagcccccaaaagaugccccucuccaaggagcucggcuuuagcccuuacauggugaggagaaggcgggcagcucagcgggcccgcucacacuuuccuggcucugcacccucaucuguggggcaucgggcaaacaggacuguuccuggggcacacagcaggcuacaugugcagaauggggacagccccagccuggccccacaaacuacugauuccagaguacgaagaccuucuuccaggaagccuucacuaccuucagauccucaagacagaccagguacccuggagggcagcaaacaaagccagacagagcccgagggggcuagagggagcaaagcagccuuucuucgccagccuucugguucuggccgggccccaaguccugcugccccaugccucuccaaagccucaccugacuugccugaacaguggcagcuguggcccccagugcccucaggcugugccucccugucuucucaacacagcuauuuugauacugaguccagcagcucagaugaguucuucugccgcugccaccggcccuacugugaaaucugcuuccagagcucuucugacucuagugacaguggcacaucagacacugacccugagccuacuggggggcuggcuuccugggaaaagcugugggcccgcuccaagccuauugugaacuucaaagaugacuugaaacccacgcuggug

SEQ ID NO: 31 - DNA, 9 bp, Artificial Sequence
  GPR156 forward primer
tctccccag

SEQ ID NO: 32 - DNA, 9 bp, Artificial Sequence
  GPR156 forward primer
agaggggtc

SEQ ID NO: 33 - DNA, 9 bp, Artificial Sequence
  GPR156 forward primer
tctccccat

SEQ ID NO: 34 - DNA, 8 bp, Artificial Sequence
  GPR156 forward primer
agagggga

SEQ ID NO: 35 - DNA, 21 bp, Artificial Sequence
  GPR156 forward primer
ccagagtctcctaccagatag

SEQ ID NO: 36 - DNA, 20 bp, Artificial Sequence
  GPR156 reverse primer
agaaggctggcgaagaaagg

SEQ ID NO: 37 - DNA, 20 bp, Artificial Sequence
  GPR156 forward primer
caacgccaaagagaagattg

SEQ ID NO: 38 - DNA, 21 bp, Artificial Sequence
  GPR156 reverse primer
cttccaggtttgctgatgaca

SEQ ID NO: 39 - DNA, 21 bp, Artificial Sequence
  GPR156 forward primer
aagatatctgactcaaaagac

SEQ ID NO: 40 - DNA, 20 bp, Artificial Sequence
  GPR156 reverse primer
agagccaggaaagtgtgagc

SEQ ID NO: 41 - DNA, 21 bp, Artificial Sequence
  GPR156 forward primer
tttcagaatgatcctggcatg

SEQ ID NO: 42 - DNA, 21 bp, Artificial Sequence
  GPR156 reverse primer
actgttcttccaggtttgctg

What is claimed:

1. A cDNA comprising a nucleic acid sequence encoding at least a portion of a human G protein-coupled receptor 156 (GPR156) protein, wherein the portion comprises an aspartic acid at a position corresponding to position 533 according to SEQ ID NO:4, and wherein the cDNA comprises at least 30 contiguous nucleotides of the nucleotide sequence encoding the portion of the human GPR156.

2. The cDNA according to claim 1, wherein the cDNA encodes a full length human GPR156 protein comprising an aspartic acid at a position corresponding to position 533 according to SEQ ID NO:4.

3. The cDNA according to claim 1, wherein the aspartic acid is encoded by the codon GAT.

4. The cDNA according to claim 3, wherein the cDNA comprises the nucleic acid sequence of SEQ ID NO:16.

5. The cDNA according to claim 3, wherein the cDNA is single-stranded.

6. A molecular complex comprising the single stranded cDNA according to claim 5 hybridized to an allele-specific primer or probe comprising a nucleic acid sequence which is complementary to the cDNA sequence encoding a portion of GPR156 protein comprising an aspartic acid at a position corresponding to position 533, wherein the aspartic acid is encoded by the codon GAT.

7. A molecular complex comprising the single stranded cDNA according to claim 5 hybridized to an allele-specific primer or probe comprising a nucleic acid sequence which is complementary to the complement of the cDNA sequence encoding a portion of GPR156 protein comprising an aspartic acid at a position corresponding to position 533, wherein the aspartic acid is encoded by the codon GAT.

8. The cDNA according to claim 1, wherein the aspartic acid is encoded by the codon GAC.

9. The cDNA according to claim 8, wherein the cDNA comprises the nucleic acid sequence of SEQ ID NO:17.

10. The cDNA according to claim 8, wherein the cDNA is single-stranded.

11. A molecular complex comprising the single stranded cDNA according to claim 10 hybridized to an allele-specific primer or probe comprising a nucleic acid sequence which is complementary to the cDNA sequence encoding a portion of GPR156 protein comprising an aspartic acid at a position corresponding to position 533, wherein the aspartic acid is encoded by the codon GAC.

12. A molecular complex comprising the single stranded cDNA according to claim 10 hybridized to an allele-specific primer or probe comprising a nucleic acid sequence which is complementary to the complement of the cDNA sequence encoding a portion of GPR156 protein comprising an aspartic acid at a position corresponding to position 533, wherein the aspartic acid is encoded by the codon GAC.

13. A vector comprising the cDNA according to claim 1.

14. The vector according to claim 13, wherein the vector is a plasmid or a virus.

15. A host cell comprising the vector according to claim 13.

16. The host cell according to claim 15, wherein the cDNA is operably linked to a promoter active in the host cell.

17. The host cell according to claim 16, wherein the promoter is an exogenous promoter or an inducible promoter.

18. A host cell comprising the cDNA according to claim 1.

19. The cDNA according to claim 1, wherein the cDNA is single-stranded.

20. A molecular complex comprising the single stranded cDNA according to claim 19 hybridized to an allele-specific primer or probe comprising a nucleic acid sequence which is complementary to the cDNA sequence encoding a portion of GPR156 protein comprising an aspartic acid at a position corresponding to position 533 according to SEQ ID NO:4.

21. A molecular complex comprising the single stranded cDNA according to claim 19 hybridized to an allele-specific primer or probe comprising a nucleic acid sequence which is complementary to the complement of the cDNA sequence encoding a portion of GPR156 protein comprising an aspartic acid at a position corresponding to position 533 according to SEQ ID NO:4.

22. An allele-specific primer or probe comprising a nucleic acid sequence which is complementary to a nucleic acid sequence encoding GPR156 protein comprising an aspartic acid at a position corresponding to position 533 according to SEQ ID NO:4.

23. The allele-specific primer according to claim 22, wherein the aspartic acid is encoded by the codon GAT.

24. The allele-specific primer according to claim 22, wherein the aspartic acid is encoded by the codon GAC.

25. A nucleic acid molecule comprising the complement of a nucleic acid sequence encoding at least a portion of a human G protein-coupled receptor 156 (GPR156) protein, wherein the portion comprises an aspartic acid at a position corresponding to position 533 according to SEQ ID NO:4, and wherein the nucleic acid molecule comprises the complement of at least 30 contiguous nucleotides of the nucleotide sequence encoding the portion of the human GPR156.

26. The nucleic acid molecule according to claim 25, wherein the nucleic acid molecule comprises the complement of a nucleic acid sequence that encodes a full length human GPR156 protein comprising an aspartic acid at a position corresponding to position 533 according to SEQ ID NO:4.

27. The nucleic acid molecule according to claim 25, wherein the aspartic acid is encoded by the codon GAT.

28. The nucleic acid molecule according to claim 27, wherein the nucleic acid molecule comprises the complement of SEQ ID NO:16.

29. The nucleic acid molecule according to claim 25, wherein the aspartic acid is encoded by the codon GAC.

30. The nucleic acid molecule according to claim 29, wherein the nucleic acid molecule comprises the complement of SEQ ID NO:17.

31. A vector comprising the nucleic acid molecule according to claim 25.

32. The vector according to claim 31, wherein the vector is a plasmid or a virus.

33. A host cell comprising the vector according to claim 31.

34. The host cell according to claim 33, wherein the nucleic acid molecule is operably linked to a promoter active in the host cell.

35. The host cell according to claim 34, wherein the promoter is an exogenous promoter or an inducible promoter.

36. A host cell comprising the nucleic acid molecule according to claim 25.

* * * * *